United States Patent 11,446,398 (REGULATED BIOCIRCUIT SYSTEMS) - sequence listing, part 30

SEQ ID NO: 112874 - DNA, 3954 bp, Homo sapiens
  Payload ID: 2089
  Gene Symbol: CDH23
  Gene Name: cadherin-related 23
  ENST ID: ENST00000299366
  CDS Start-End: 388-3573
gcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtgctgccccggcctccgcccacctgtgcaggcctcctggggccctgcctccacccctcccagatggacagccagactaggtgggggcaggtgagggtggaaaagaggtcagggctctactgttgggctttagcctctggtggtgcctcccgaggatttgctcctggctcttcccaagggctttgcagctggatcactctggactggctccctggggacctcctgaacctgttggttgcagggacggggagcatctaccaaggttcattctagagggaggtaaggccccatgattcctagggaggagccctgagccccactccccgccccaagtctgggtgacagagcagtgacttggaggaatgtggcctcatccttccttggggacctgttgagaattcccacctgtttagaggcagatggttttgatctccctaaatgaaatggttttagctcaaaaa

SEQ ID NO: 112875 - DNA, 4329 bp, Homo sapiens
  Payload ID: 2089
  Gene Symbol: CDH23
  Gene Name: cadherin-related 23
  Uniprot ID: Q9H251
  ENST ID: ENST00000398788
  CDS Start-End: 318-3662
ccctgctgcaccctgaactaactgatgttaaccctcttctctcttcctcatggctggcaggcccacaggtttgagctctgtttctctgtcacttcccacctcatctcttctctgcctcaccccattgccttcctccatgcccaccacacccccaccacccttcctgtcctgtggggcctgggccaaggccgtggcccagcctttgcagactgaatgcagccgccctctccccatcctcgctccccagcctgggggacagggagcgagagtaggaagaggaggaggaggaggaggaggaggcggcccagggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 112876 - DNA, 4533 bp, Homo sapiens
  Payload ID: 2089
  Gene Symbol: CDH23
  Gene Name: cadherin-related 23
  ENST ID: ENST00000398809
  CDS Start-End: 391-4533
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggcagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacggtgaggggctgggggcagggagcaccatttcttccaatctaa

SEQ ID NO: 112877 - DNA, 1759 bp, Homo sapiens
  Payload ID: 2089
  Gene Symbol: CDH23
  Gene Name: cadherin-related 23
  ENST ID: ENST00000398842
  CDS Start-End: 403-1740
cgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccttggccatcatcatcaccaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactctt

SEQ ID NO: 112878 - DNA, 7000 bp, Homo sapiens
  Payload ID: 2089
  Gene Symbol: CDH23
  Gene Name: cadherin-related 23
  ENST ID: ENST00000442677
  CDS Start-End: 1-2411
cggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggaagacttggcctccccctgcatatctcccgccccacccagaagggcctttcagagtagcggggagaaagagacgtcacaatttcccggaaaggagttgagaagagagccagggcccagcaaggcccagaacagagctgctttcacagagcccttggccgaggctcccctcttgggaagtaaacaggcacaagaagaaagggctcctttgcccagggagcaggcgcaacagctccaaggctcagagggagagaagggaggaccctgaaaacaatttgggtgtgcacccacacctctgcccagaggcctcagttgctgggtggggagggaggcccggagtgaatgagtctctttaccaactatggggtttccgactcggaggctgagccaaacagggaatctgggcctgcccactggggcaggctcccgggcttgggagggacagaagcgtgggaggctggcaatgctcccctccctgcatcgggaccaggaggcgggcaggaaagggctggggagcagggagctgactcccagaaacacagagagcccagaaagccctgaggatttgcgagagtgtggtggctagctccagaaggaggaagtagagggttctctcgatcagggcctcagcttgtgaggacttggagcatacccccctggcctggtgcctgaaacccaattgagagccctccccctcctggacttttccttcttcaggcctcagggcagcctcaacccccaccccaacctccaggaagacagtgcctagtggccagcagggcctgctggtgaggtggatggctacaggctgaatccagcctaggatttgcagggaggccccaggggaagcaaaccaggaagaggttactgagcaggaagggaggaaggaacaaaacccttagggaggaggcctgccccactttctaaacccaaagacttggtttctatttacacaatactactcttactgaaatcctagagccagcgagttaatatagggcagccctgagttctcccatttctcagggagaaatgcagcgtctcaggatgacttctccaaggtcctcttggtaagtttcttgtgaagccggactcactttttgagatcagattgacttggaaggaagggacagtgggcttctccaatagagcctgcttggagagaaatctttctagagtcatctgagggaagatgaggctctgtgttatgccagcttccaccaagactcctgcctcagagggtggggacacacccaggctgggccacgcttcactctgtacacagaagcctcatacttctgtgcacagaactggggagtcaaagtgaggggctggacaatgtctggctctctgcaagctcccaagctggtaggaaagagaagacatagacaaaaaggacccatgctgccaagagaatgttccttttcctccccaagagaggtaggagacagtaggggcggctccaggcaggagggcttcacagagtgggtgtgtgtgaagcataagccacagttagtgggtgacaggtctttcagttttcctggagttttggatcaagatgaggctagaaagattaattggagccagctcccagagggcactgcacactgcgctgaggagctttggctatatccatttggcattagggagccagtgaaggttttggagctggggagtggcaagccagagctcactccttggggagacgtggctggctgcactgtgggtcacagcaggatgggggtggggcagctttgtggtgggatcctggccagctgactgggacaggagctgggcagcccaggtcctccctctgcccacccttcaaatttgggacctgaccaaagtgtttaaccctcgcgttgtgaggagaggtcaagggtttgggattctgagaagcccatcctggggtgggactgctttgacgggtcatcagcaaagcactcaccaaaaccacagatagcatccctagtgtgggcaggacttgggaccccacagctgtcctggagaggtccagaccatcccaccctcggggaggctgccgctttccctgggtgaggtgtggagctgctgtgagctgtcctcctccgagtccaggtggcatcacctccagctgctggaaatgccctgcctcttgccactctgtcacagcacccgccctggcctctgaagggagcctcctcgatcatcttcaatcccttcctgattgatcccaacgtgggtgccctgaagaggggccaccaagacggctgccaagaccatgcttggagagccctgtttgctcctcctcccagctggcacccaggcatctgttccaccaggagggaggcagctgctcccacagggcaccaggcagatgctggcagcacccgggaaacccaaggaagagagccccgaggttttgccccagcactgggccagcacagatgccaggacagtgtcttggccccggtgtaggctgagcatttcacttgactaaagggaacctttgccatttggcaacttctccatgctgggctttggcacctggagggcaaggcttctgtggcgagcgagggtgctgcttctaggaggtggttacgagccccaggttgtaccctgtggagcctcaggccaaaggcccagatgaccacgagtgcacatctcttgaccagaagtctttcatcaagcagcagcgagggggtctgcagagaggaaggtgctcttctgaggatcatctttgggaaagggcgctggcctgggcatgcaaggagcttcggggggtgagtgtgtgtcccagactgcttgggccactgtcttcctgcagcctgcagcaccggtctctgaagcaggaggatctacaggtagacctagggggatgtgggggcatgtttgtggacaccccattacatcttggtagattccatgtagtcacagtggctgcggttgtcctcggggcccggcaggggctgtcgagggacggtgggccggccatggcggaagctgtgcagggagaggcgcaaggagcccaggcgcttccagagccggagctggggctcactggggctcccagggtggtggggcatgcactcgtgagccctgcggcggctcgggtccagcgcggccggcttgcagagcgtcatgaacagcagacaggtggccagcaggaggaagatgcaggccagggcgatgagcatggggagggggtcagttgcctctgcaagggtcccgggagtgacgggagctgagagaaaggcgagggggctgatggctggggagctggcgaggctggggccctctgtgctcatggctcctgcaacagcaacaagacagaagctcaaaggcagatcagctggacccagggcagcgggtatagggaagacttacctagggaatgtggatgggggcaaggcactgttaaactggacagcatcatggccacatcacaggttaagacagcaaggtccagagacatcacaagtctaagtgtacacacagctgagcagtgatggagctgggcccaagctcaggccctcttcctgttccaccctgtgcccatctgccatgcagacaagagggcggtggcctgtccgcattttcaaatcaatcctcatgaatcatcacagggtcttaggcctggaaacttaagaccaactctgtcaataacttgctctgtggccaggaacgagttatggatggtaagaggccgcagctgccagggtccctagcagtaatctaataccaaagctgcaaactgggggcccacgggtgtgtttagttgggtccttgccatgtttttatcaatgtaattatgaatattttcaaaataataacagatttcacaaaaatatatgggtgcctgaattctcttgaaatgtcagaatttcaccactggcattggcccatgttcctgcctcatccctgtgtctggggctgagcagccgctgccccctgtagacagggcactgacctccagctccccaccctcccccacaggcccaccacacaccttatttcacctgcctggccccgtggggattcctgtgactgcttccccatgcagtccaacttgctcccacgacaggtgggaaactgaggtccgaagaggggatttggcattagggagccagtgaaggttttagaggtggggagtgacaagccagagctcactccttgggaaggcttggctggctgcattgtgggtcacagtagggtggggtggggcagcttggtggtgggaaggccaaggccacattgtgagccaatggccaagtgaaggtcagaagcaggtctcctgactcctggccccatggccttgccacccctctggcccccagccctttcggagctcagtgagctgctctgggaacaggtgggaaataaacccacaaggagttgacaagggggctggaaaccccccagggacatcatacacctgacagggcatttcctttcccactgaagatcatcccattagacgcagtgcagcagacggtccttgtcgatggaaaaccaggctgagcttttggctcaatatgtctggggttgtaataaaaatgctcacagatcctggccagcagataacacatgaccagagggtacagatgagcagggccacctggagagcactggctgggccctctcaaggaagtggaggggcctcagcccagaatggtgctgtcagtgccggagtgcaggcccagtgtggtcagctctgtcagtttcccaagagaagccagaaatctggatttttttaaaggcaaacattctagacgtttaaatgttggcagctaattcaaatttgttgaaggcaagaaagaagagaggtggggtgggggagaacacagcaaaagccaaataaacttgatttcaaaataa

SEQ ID NO: 112879 - DNA, 2000 bp, Homo sapiens
  Payload ID: 2089
  Gene Symbol: CDH23
  Gene Name: cadherin-related 23
  ENST ID: ENST00000461841
  CDS Start-End: 389-1981
ggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggtgagtccccgcttcactgcagggccactgagctctccagggccgactgtggtgaggcacccagagggattttgtccaagggacctcagcaatcagggaaggaggcacccccaaatccctgagctgtgtttgttggtgtattaaataaagtttttggactctt

SEQ ID NO: 112880 - DNA, 4475 bp, Homo sapiens
  Payload ID: 2089
  Gene Symbol: CDH23
  Gene Name: cadherin-related 23
  ENST ID: ENST00000466757
  CDS Start-End: 1-2863
agacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgaggagaacggaggctggcttcagggccgaccggagggagtgggggaaggtctgcacgtgcagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcaggcagcacccgccctggcctctgaagggagcctcctcgatcatcttcaatcccttcctgattgatcccaacgtgggtgccctgaagaggggccaccaagacggctgccaagaccatgcttggagagccctgtttgctcctcctcccagctggcacccaggcatctgttccaccaggagggaggcagctgctcccacagggcaccaggcagatgctggcagcacccgggaaacccaaggaagagagccccgaggttttgccccagcactgggccagcacagatgccaggacagtgtcttggccccggtgtaggctgagcatttcacttgactaaagggaacctttgccatttggcaacttctccatgctgggctttggcacctggagggcaaggcttctgtggcgagcgagggtgctgcttctaggaggtggttacgagccccaggttgtaccctgtggagcctcaggccaaaggcccagatgaccacgagtgcacatctcttgaccagaagtctttcatcaagcagcagcgagggggtctgcagagaggaaggtgctcttctgaggatcatctttgggaaagggcgctggcctgggcatgcaaggagcttcggggggtgagtgtgtgtcccagactgcttgggccactgtcttcctgcagcctgcagcaccggtctctgaagcaggaggatctacaggtagacctagggggatgtgggggcatgtttgtggacaccccattacatcttggtagattccatgtagtcacagtggctgcggttgtcctcggggcccggcaggggctgtcgagggacggtgggccggccatggcggaagctgtgcagggagaggcgcaaggagcccaggcgcttccagagccggagctggggctcactggggctcccagggtggtggggcatgcactcgtgagccctgcggcggctcgggtccagcgcggccggcttgcagagcgtcatgaacagcagacaggtggccagcaggaggaagatgcaggccagggcgatgagcatggggagggggtcagttgcctctgcaagggtcccgggagtgacgggagctgagagaaaggcgagggggctgatggctggggagctggcgaggctggggccctctgtgctcatggctcctgcaacagcaacaagacagaagctcaaaggcagatcagctggacccagggcagcgggtatagggaagacttacctagggaatgtggatgggggcaaggcactgttaaactggacagcatcatggccacatcacaggttaagacagcaaggtccagagacatcacaagtctaagtgtacacacagctgagcagtgatggagctgggcccaagctcaggccctcttcctgttccaccctgtgcccatctgccatgcagacaagagggcggtggcctgtccgcattttcaaatcaatcctcatgaatcatcacagggtcttaggcctggaaacttaagaccaactctgtcaataacttgctctgtggccaggaacgagttatggatggtaagaggccgcagctgccagggtccctagcagtaatctaataccaaagctgcaaactgggggcccacgggtgtgtttagttgggtccttgccatgtttttatcaatgtaattatgaatattttcaaaataataacagatttcac

SEQ ID NO: 112881 - DNA, 4224 bp, Homo sapiens
  Payload ID: 2089
  Gene Symbol: CDH23
  Gene Name: cadherin-related 23
  Uniprot ID: Q9H251
  ENST ID: ENST00000619887
  CDS Start-End: 318-3557
ccctgctgcaccctgaactaactgatgttaaccctcttctctcttcctcatggctggcaggcccacaggtttgagctctgtttctctgtcacttcccacctcatctcttctctgcctcaccccattgccttcctccatgcccaccacacccccaccacccttcctgtcctgtggggcctgggccaaggccgtggcccagcctttgcagactgaatgcagccgccctctccccatcctcgctccccagcctgggggacagggagcgagagtaggaagaggaggaggaggaggaggaggaggcggcccagggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 112882 - DNA, 704 bp, Homo sapiens
  Payload ID: 2089
  Gene Symbol: CDH23
  Gene Name: cadherin-related 23
  ENST ID: ENST00000470494
  CDS Start-End: 1-496
tgacaatgccccggagttcaacagctccgagtacagcgtggccatcactgagctggcacaggtcggctttgcccttccactcttcatccaggtggtggacaaggatgagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctgtgggaaaagttcttttgcagtaattccagcagattctcatcggcccagttggttgtgtcatcctggaaccaattgtgattctggtatgccggggagggatcacactccccctagtggacccaggggttggggtcagccccgcctgaattacaccgtctgagaatggggaaggggcttctattctaagacaagggattgaatgctaagcagatccaagtggtagatgtgtgctacacaagctcagagtcttgcccagtcggtgctcaataaatgtcacggagtttaa

SEQ ID NO: 112883 - DNA, 4814 bp, Homo sapiens
  Payload ID: 2089
  Gene Symbol: CDH23
  Gene Name: cadherin-related 23
  ENST ID: ENST00000616684
  CDS Start-End: 363-4508
cgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagaatttgggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacggtgaggggctgggggcagggagcaccatttcttccaatctaaccaacattggttgagctccttctgtgtgcacagcactctcctctttgtcataaaatgtccttgagatggccaagtgtggtgttaggtacctgtagtcccagctgcttgagaggctggggcaggaagattgcttcagctcaggagtttggaggctgcagtgagctgcgtttgcaccactgcactccagcccgggcaacagagtgagaccttgtctcttacaaagaaacaaaaaaaagtccccgagatcaatatccctgtaacacatccattttcatatgtaggagtaagataaagtttatacctatg

SEQ ID NO: 112884 - DNA, 11122 bp, Homo sapiens
  Payload ID: 2089
  Gene Symbol: CDH23
  Gene Name: cadherin-related 23
  ENST ID: ENST00000622827
  CDS Start-End: 391-10455
gcggcggcggcggctcgggagagagggacgcgggctgcaggcgcgatgcttggctagaggacgcgtccgacggcggccggacgctgaggtggtcggggctagtcagcccggcctgggcatggagcgcggggtggcagagcctctggacgtttggggcgcgcccagtccgagcccccggcgcgcctgaagttgcgagcggcgagcggcgagcggcgagcggcccgcggagacccaggagctgccggcacgccgcggatgagccttcgcgccggcgggaagacgcggcggtggccagggccagagcaggcggcccgcgggggccgatccggcggagagcagagcccgaggcgaggcgaggcgcggcgccgctgcacacacgcacacggagccatggggcgccatgttgccaccagctgccacgtggcctggcttttggtgctgatctctggatgctggggccaggtgaaccggctgcccttcttcaccaaccacttctttgatacatacctgctgatcagcgaggacacgcctgtgggttcttctgtgacccagttgctggcccaagacatggacaatgaccccctggtgtttggcgtgtctggggaggaggcctctcgcttctttgcagtggagcctgacactggcgtggtgtggctccggcagccactggacagagagaccaagtcagagttcaccgtggagttctctgtcagcgaccaccagggggtgatcacacggaaggtgaacatccaggttggggatgtgaatgacaacgcgcccacatttcacaatcagccctacagcgtccgcatccctgagaatacaccagtggggacgcccatcttcatcgtgaatgccacagaccccgacttgggggcagggggcagcgtcctctactccttccagcccccctcccaattcttcgccattgacagcgcccgcggtatcgtcacagtgatccgggagctggactacgagaccacacaggcctaccagctcacggtcaacgccacagatcaagacaagaccaggcctctgtccaccctggccaacttggccatcatcatcacagatgtccaggacatggaccccatcttcatcaacctgccttacagcaccaacatctacgagcattctcctccgggcacgacggtgcgcatcatcaccgccatagaccaggataaaggacgtccccggggcattggctacaccatcgtttcagggaataccaacagcatctttgccctggactacatcagcggagtgctgaccttgaatggcctgctggaccgggagaaccccctgtacagccatggcttcatcctgactgtgaagggcacggagctgaacgatgaccgcaccccatctgacgctacagtcaccacgaccttcaatatcctggttattgacatcaatgacaatgccccggagttcaacagctccgagtacagcgtggccatcactgagctggcacaggtcggctttgcccttccactcttcatccaggtggtggacaaggatgagacccagggcctgaacagcatgtttgaggtgtacttggtggggaacaactcccaccacttcatcatctccccgacctccgtccaggggaaggcggacattcgtattcgggtggccatcccactggactacgagaccgtggaccgctacgactttgatctctttgccaatgagagtgtgcctgaccatgtgggctatgccaaggtgaagatcactctcatcaatgaaaatgacaaccggcccatcttcagccagccactgtacaacatcagcctgtacgagaacgtcaccgtggggacctctgtgctgacagtcctggcaactgacaatgatgcaggcacctttggggaagtcagctacttcttcagtgatgaccctgacaggttctcgctggacaaggacacgggactcatcatgctgattgccaggctggactatgagctcatccagcgcttcaccctgacgatcattgcccgggacgggggcggcgaggagaccacaggccgggtcaggatcaatgtgttggatgtcaacgacaacgtgcccaccttccagaaggatgcctacgtgggtgctctgcgggagaacgagccttctgtcacacagctggtgcggctccgggcaacagatgaagactcccctcccaacaaccagatcacctacagcattgtcagtgcatctgcctttggcagctacttcgacatcagcctgtacgagggctatggagtgatcagcgtcagtcgccccctggattatgaacagatatccaatgggctgatttatctgacggtcatggccatggatgctggcaacccccctctcaacagcaccgtccctgtcaccatcgaggtgtttgatgagaatgacaaccctcccaccttcagcaagcccgcctacttcgtctccgtggtggagaacatcatggcaggagccacggtgctgttcctgaatgccacagacctggaccgctcccgggagtacggccaggagtccatcatctactccttggaaggctccacccagtttcggatcaatgcccgctcaggggaaatcaccaccacgtctctgcttgaccgagagaccaagtctgaatacatcctcatcgttcgcgcagtggacgggggtgtgggccacaaccagaaaactggcatcgccaccgtaaacatcaccctcctggacatcaatgacaaccaccccacgtggaaggacgcaccctactacatcaacctggtggagatgacccctccagactctgatgtgaccacggtggtggctgttgacccagacctgggggagaatggcaccctggtgtacagcatccagccacccaacaagttctacagcctcaacagcaccacgggcaagatccgcaccacccacgccatgctggaccgggagaaccccgacccccatgaggccgagctgatgcgcaaaatcgtcgtctctgttactgactgtggcaggccccctctgaaagccaccagcagtgccacagtgtttgtgaacctcttggatctcaatgacaatgaccccacctttcagaacctgccttttgtggccgaggtgcttgaaggcatcccggcgggggtctccatctaccaagtggtggccatcgacctcgatgagggcctgaacggcctggtgtcctaccgcatgccggtgggcatgccccgcatggacttcctcatcaacagcagcagcggcgtggtggtcaccaccaccgagctggaccgcgagcgcatcgcggagtaccagctgcgggtggtggccagtgatgcaggcacgcccaccaagagctccaccagcacgctcaccatccatgtgctggatgtgaacgacgagacgcccaccttcttcccggccgtgtacaatgtgtctgtgtccgaggacgtgccacgcgagttccgggtggtctggctgaactgcacggacaacgacgtgggcctcaatgcagagctcagctacttcatcacaggtggcaacgtggatgggaagttcagcgtgggttaccgcgatgccgttgtgagaaccgtggtgggcctggaccgggagaccacagccgcctacatgctcatcctggaggccatcgacaacggccctgtagggaagcgacacacgggcacagccaccgtgttcgtcactgtcctggatgtgaatgacaaccggcccatctttctgcagagcagctatgaggccagcgtccctgaggacatccctgaaggccacagcatcttgcagctgaaagccacggacgcagatgagggcgagtttgggcgtgtgtggtaccgcatcctccatggtaaccatggcaacaacttccggatccatgtcagcaatgggctcctgatgcgagggccccggcccctggaccgggagcggaactcatcccacgtgctgatagtggaggcctacaaccacgacctgggccccatgcggagctccgtcagggtgattgtgtacgtggaggacatcaacgatgaggcccccgtgttcacacagcagcagtacagccgtctggggcttcgagagaccgcaggcattggaacgtcagtcatcgtggtccaagccacagaccgagactctggggatggtggcctggtgaactaccgcatcctgtcgggcgcagaggggaagtttgagattgacgagagcacagggcttatcatcaccgtgaattacctggactacgagaccaagaccagctacatgatgaatgtgtcggccactgaccaggccccgcccttcaaccagggcttctgcagcgtctacatcactctgctcaacgagctggacgaggccgtgcagttctccaatgcctcatacgaggctgccatcctggagaatctggcactgggtactgagattgtgcgggtccaggcctactccatcgacaacctcaaccaaatcacgtaccgcttcaacgcctacaccagcacccaggccaaagccctcttcaagatagacgccatcacgggtgtgatcacagtccagggcctggtggaccgtgagaagggcgacttctataccttgacagtggtggcagatgacggcggccccaaggtggactccaccgtgcaggtctacatcactgtgctggacgagaatgacaacagcccccggtttgacttcacctccgactcggcggtcagcatacccgaggactgccctgtgggccagcgagtggctactgtcaaggcctgggaccctgatgctggcagcaatgggcaggtggtcttctccctggcctctggcaacatcgcgggggcctttgagatcgtcaccaccaatgactccattggcgaagtgtttgtggccaggcccctggacagagaagagctggatcactacatcctccaggttgtggcttctgaccgaggcacccctccacggaagaaggaccacatcctgcaggtgaccatcctggacatcaatgacaaccctccagtcatcgagagcccctttggatacaatgtcagtgtgaatgagaacgtgggtggaggtactgctgtggtccaggtgagagccactgaccgtgacatcgggatcaacagtgttctgtcctactacatcaccgagggcaacaaggacatggccttccgcatggaccgcatcagcggtgagatcgccacacggcctgccccgcctgaccgcgagcgccagagcttctaccacctggtggccactgtggaggacgagggcaccccaaccctgtcggccaccacgcacgtgtacgtgaccattgtggatgagaatgataacgcgcccatgttccagcagccccactatgaggtgctgctggatgagggcccagacacgctcaacaccagcctcatcaccatccaggcactggacctggatgagggtcccaacggcacagtcacctatgccatcgtcgcaggcaacatcgtcaacaccttccgcatcgacagacacatgggtgtcatcactgctgccaaagagctggactacgagatcagccacggccgctacaccctgatcgtcactgccacagaccagtgccccatcttatcccaccgcctcacctctaccaccacggtgcttgtgaatgtgaatgacatcaacgacaatgtgcctaccttcccccgggactatgagggaccatttgaagtcactgagggccagccggggcccagagtgtggaccttcctggcccatgaccgagactcaggacccaacgggcaggtggagtacagcatcatggatggagaccctctgggggagtttgtgatctctcctgtggagggggtgctaagggtccggaaggacgtggagctggaccgggagaccatcgccttctacaacctgaccatctgtgcccgtgaccgggggatgcccccactcagctccacaatgctggtggggatccgggtgctggacatcaacgacaacgaccctgtgctgctgaacctgcccatgaacatcaccatcagcgagaacagccctgtctccagctttgtcgcccatgtcctggccagtgacgctgacagtggctgcaatgcacgcctcaccttcaacatcactgcgggcaaccgcgagcgggccttcttcatcaatgccacgacagggatcgtcactgtgaaccggcccctggaccgcgagcggatcccagagtacaagctgaccatttctgtgaaggacaacccggagaatccacgcatagccaggagggattatgacttgcttctgatcttcctttctgatgagaatgacaaccaccccctcttcactaaaagcacctaccaggcagaggtgatggaaaactctcccgctggcacccctctcacggtgctcaatgggcccatcctggccctggatgcagaccaagacatctacgccgtggtgacctaccagctgctgggtgcccagagtggcctctttgacatcaacagcagcaccggtgtggtgaccgtgaggtcaggtgtcatcattgaccgggaggcattctcgccacccatcctggagctgctgctgctggctgaggacatcgggctgctcaacagcacggcccacctgctcatcaccatcctggatgacaatgacaaccggcccacctttagccctgccaccctcactgtccatctgctagagaactgcccgcctggattctcagtccttcaagtcacagccacagatgaggacagtggcctcaatggggagctggtctaccgaatagaagctggggctcaggaccgcttcctcattcatctggtcaccggggtcatccgtgttggtaatgccaccatcgacagagaggagcaggagtcctacaggctaacggtggtggccaccgaccggggcaccgttcctctctcgggcacagccattgtcaccattctgatcgatgacatcaatgactcccgccccgagttcctcaaccccatccagacagtgagcgtgctggagtcggctgagccaggcactgtcattgccaatatcacggccattgaccacgacctcaacccaaagctagagtaccacattgtcggcattgtggccaaggacgacactgatcgcctggtgcccaaccaggaggacgcctttgctgtgaatatcaacacaggatctgtaatggtgaagtcccccatgaatcgggagctggttgccacctatgaggtcactctctcagtgattgacaatgccagcgacctaccagagcgctctgtcagtgtgccaaatgccaagctgactgtcaacgtcctggacgtcaatgacaatacgccccagttcaagccctttgggatcacctactacatggagcggatcctggagggggccacccctgggaccacactcattgctgtggcagccgtggaccctgacaagggccttaatgggctggtcacctacaccctgctggacctggtgcccccagggtatgtccagctggaggactcctcggcagggaaggtcattgccaaccggacagtggactacgaggaggtgcactggctcaactttaccgtgagggcctcagacaacgggtccccgccccgggcagctgagatccctgtctacctggaaatcgtggacatcaatgacaacaaccccatctttgaccagccctcctaccaggaggctgtctttgaggatgtgcctgtgggcacaatcatcctgacagtcactgccactgatgctgactcaggcaactttgcactcattgagtacagccttggagatggagagagcaagtttgccatcaaccccaccacgggtgacatctatgtgctgtcttctctggaccgggagaagaaggaccactatatcctgactgccttggccaaagacaaccctggggatgtagccagcaaccgtcgcgaaaattcagtgcaggtggtgatccaagtgctggatgtcaatgactgccggccacagttctccaagccccagttcagcacaagcgtgtatgagaatgagccggcgggcacctcggtcatcaccatgatggccactgaccaggatgaaggtcccaatggagagttgacctactcacttgagggccctggcgtggaggccttccatgtggacatggactcgggcttggtgaccacacagcggccactgcagtcctacgagaagttcagtctgaccgtggtggccacagatggtggagagcccccactctggggcaccaccatgctcctggtggaggtcatcgacgtcaatgacaaccgccctgtctttgtgcgcccacccaacggcaccatcctccacatcagagaggagatcccgctgcgctccaacgtgtacgaggtctacgccacggacaaggatgagggcctcaacggggcggtgcgctacagcttcctgaagactgcgggcaaccgggactgggagttcttcatcatcgacccaatcagcggcctcatccagactgctcagcgcctggaccgcgagtcgcaggcggtgtacagcctcatcttggtggccagcgacctgggccagccagtgccatacgagactatgcagccgctgcaggtggccctggaggacatcgatgacaacgaaccccttttcgtgaggcctccaaaaggcagcccccagtaccagctgctgacagtgcctgagcactcaccacgcggcaccctcgtgggcaacgtgacaggcgcagtggatgcagatgagggccccaacgcgatcgtgtactacttcatcgcagccggcaacgaagagaagaacttccatctgcagcccgatgggtgtctgctggtgctgcgggacctggaccgggagcgagaagccatcttctccttcatcgtcaaggcctccagcaatcgcagctggacacctccccgtggaccctccccaaccctcgacctggttgctgacctcacactgcaggaggtgcgcgttgtgctagaggacatcaacgaccagccaccacgcttcaccaaggctgagtacactgcaggggtggccaccgacgccaaggtgggctcagagttgatccaggtgctggccctggatgcagacattggcaacaacagccttgtcttctacagcattctggccatccactacttccgggcccttgccaacgactctgaagatgtgggccaggtcttcaccatggggagcatggacggcattctgcgcaccttcgacctcttcatggcctacagccccggctacttcgtggtggacattgtggcccgagacctggcaggccacaacgacacggccatcatcggcatctacatcctgagggacgaccagcgcgtcaagatcgtcattaacgagatccccgaccgtgtgcgcggcttcgaggaggagttcatccacctgctctccaacatcactggggccattgtcaatactgacaatgtgcagttccatgtggacaagaagggccgggtgaactttgcgcagacagaactgcttatccacgtggtgaaccgcgataccaaccgcatcctggacgtggaccgggtgatccagatgatcgatgagaacaaggagcagctacggaatcttttccggaactacaacgtcctggacgtgcagcctgccatctctgtccggctgccggatgacatgtctgccctgcagatggcgatcatcgtcctggctatcctcctgttcctggccgccatgctctttgtcctcatgaactggtactacaggactgtacacaagaggaagctcaaggccattgtggctggctcagctgggaatcgtggcttcatcgacatcatggacatgcctaacaccaacaagtactcctttgatggagccaaccctgtgtggctggatcccttctgtcggaacctggagctggccgcccaggcggagcatgaggatgacctaccggagaacctgagtgagatcgccgacctgtggaacagccccacgcgcacccatggaacttttgggcgtgagccagcagctgtcaagcctgatgatgaccgatacctgcgggctgccatccaggagtatgacaacattgccaagctgggccagatcattcgtgaggggccaatcaagggctcgctgctgaaggtggtcctggaggattacctgcggctcaaaaagctctttgcacagcggatggtgcaaaaagcctcctcctgccactcctccatctctgagctgatacagactgagctggacgaggagccaggagaccacagcccagggcagggtagcctgcgcttccgccacaagccaccagtggagctcaaggggcccgatgggatccatgtggtgcacggcagcacgggcacgctgctggccaccgacctcaacagcctgcccgaggaagaccagaagggcctgggccgctcgctggagacgctgaccgctgccgaggccactgccttcgagcgcaacgcccgcacagaatccgccaaatccacacccctgcacaaacttcgcgacgtgatcatggagacccccctggagatcacagagctgtgactagacagggaagccttgtgggtgtgagcagcacccatccaccgtcccctcccagggagcaagggcagggacagggccggtcgggggggaccctccaaggccaggccttggggacaaccttggcttggccctggcagcccgcatcagctgctcagatcccacttttgccagacgctcattcagcatctgacctctaccttcataagatctgttatttttataagaaaaccaaacaaaaatgttaagcatctaaggacaaggtaaggagggtcactggggcccaagagtctggggaccagcttggctcaggctgagctgaaagaggccaaacaggccctcctccctcccagctccaccccgcaagcaccatcccctccggctaagcaggcgcaagggaggcccagcgcggacatcccctgctggccggacacccgactccagtccaagtctcgctacatttccgccacatccctctctgctggacgtccaggtggaggtggcatccccacgtggacaagaaagtcaatgtcaatgaacaagcattctctccatttcactggcttcccaaatgtgtgcccagcttataaacagaagtgactgatgttccctccggttttgaatgtggagtgtttgtgtgtgttccttttttaaattaagttattccctc

SEQ ID NO: 112885 - DNA, 2694 bp, Homo sapiens
  Payload ID: 2090
  Gene Symbol: CDHR1
  Gene Name: cadherin-related family member 1
  Uniprot ID: Q96JP9
  ENST ID: ENST00000332904
  CDS Start-End: 112-2349
gtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcagtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgaggtgagaagactaaggtacatgaaaaatagtaacttccctggtacaacaaagtcagtaagaaaaccaaaatttaagcccaagaaaccacattccagccagggtctgttcttgcatccccactgcgaaattgccttattcaatctgagtaatgtgaatctgtactctagagtttttcaaggggcagcccaagcatcttaaaaagtatcagattctcagaaatcctccctagaccattttccctctccctaaatttctatgtttacagaagcaactgaatacttccctacccaccaacatgctcctggctctcccctgcactgcttgctgctcttccacagcccttctctcatcctgacccctctgtctcatgtgcaccaccaagcttcttttgcttggcttgaaggtctgaacatccactctcaccttcatggtagcccaggctatttcatgatggtgacaccctcaagatccgtagaccactgtattagttcgttctcatgctgctaataaagatacccgagactgggtaatttatagaggaaa

SEQ ID NO: 112886 - DNA, 4537 bp, Homo sapiens
  Payload ID: 2090
  Gene Symbol: CDHR1
  Gene Name: cadherin-related family member 1
  ENST ID: ENST00000372117
  CDS Start-End: 1-1795
catcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaaggctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtatgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctaggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacacc

SEQ ID NO: 112887 - DNA, 700 bp, Homo sapiens
  Payload ID: 2090
  Gene Symbol: CDHR1
  Gene Name: cadherin-related family member 1
  ENST ID: ENST00000622973
  CDS Start-End: 1-407
tggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagacc

SEQ ID NO: 112888 - DNA, 503 bp, Homo sapiens
  Payload ID: 2090
  Gene Symbol: CDHR1
  Gene Name: cadherin-related family member 1
  ENST ID: ENST00000623399
  CDS Start-End: 1-235
catcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgaggtgagaagactaagaagcaactgaatacttccctacccaccaacatgctcctggctctcccctgcactgcttgctgctcttccacagcccttctctcatcctgacccctctgtctcatgtgcaccaccaagcttcttttgcttggcttgaaggtctgaacatccactctcaccttcatggtagcccaggctatttcatgatggtgacaccctcaagatccgtagaccactgtattagttcgttctcatgctgctaataaagatacccgagactgggtaatttatagaggaaa

SEQ ID NO: 112889 - DNA, 587 bp, Homo sapiens
  Payload ID: 2090
  Gene Symbol: CDHR1
  Gene Name: cadherin-related family member 1
  ENST ID: ENST00000624091
  CDS Start-End: 1-145
catggatggagaccggggcaaacccaatcgaattctctacagccttgtaaatgacttccctaggcaatgcaggacgatcctgtggcacgactcccctgcgcctccctgtggtcctgtgcagaacttcagggtgcatctcccttgacagggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtc

SEQ ID NO: 112890 - DNA, 6781 bp, Homo sapiens
  Payload ID: 2090
  Gene Symbol: CDHR1
  Gene Name: cadherin-related family member 1
  Uniprot ID: Q96JP9
  ENST ID: ENST00000623527
  CDS Start-End: 127-2706
cccgccgcggctgcagtcgccgctacccccattgtggtctctgccctccccgcgggcccagggcatgctccgtgcccctgcgcccggtctcggcggcggcaggcgacactccgcgccggcggagacatgaggcgctgccggtgggccgccctggccctggggctgctgcgcctctgcttggctcaggccaacttcgccccgcacttcttcgacaacggggtcggcagcaccaacggaaacatggctctgttcagcctcccagaggacacccctgtaggctctcacgtatacaccctgaatgggacagaccctgagggagaccccatctcctaccacatcagctttgaccccagcactagaagcgtcttttctgttgaccccacttttggaaacatcaccctggttgaagagctggacagagagagggaagatgagattgaagccatcatcagcatttctgatggcctgaatctggtggccgaaaaagtcgtgatcctggtgaccgatgccaatgatgaggcgcccaggttcatccaggagccttatgttgccctggttcccgaggacatacctgctgggagcatcatctttaaggtccatgcagtggacagggacacaggctctggagggagtgtcacctacttcctgcagaacctgcactccccatttgccgtggaccgccacagcggtgtgctgcgcctccaggctggggccactctggactacgagaggtcccggacccactacatcaccgtggtcgccaaggatggcggtgggaggcttcatggggctgatgtggtgttctcagccaccaccacggtcacggtcaatgtggaggatgttcaggacatggcccctgtcttcgtgggcacaccctactatggctatgtgtacgaggacacccttccgggctcggaggtactgaaggtggtcgccatggatggagaccggggcaaacccaatcgaattctctacagccttgtaaatgggaacgatggagcctttgaaattaatgagacatctggagccatctccatcactcagagcccggcccagctccagagagaggtgtatgagctgcatgtacaggtgactgaaatgagccctgcggggagcccagctgcccaggccaccgtcccagtcaccatcaggattgtggacctcaacaaccacccgccaacattctatggagagagcggaccccaaaacaggtttgagctgtccatgaatgagcacccaccccagggagagatcctgcggggcctcaagatcaccgtcaatgactccgaccagggagccaatgccaaattcaacttgcagctggtgggacccaggggcatcttccgagtggttccacagacagtcctgaatgaagcccaagtcacaatcattgtggagaactcagctgccattgactttgaaaagtccaaagtattaaccttcaagctcctggctgttgaagtgaacaccccagagaagttcagttccacagcggatgttgtgatccagctcctggacaccaatgacaatgtccccaagttcgactccctctactacgttgccaggattcctgagaacgccccagggggctccagcgtggtggctgtcacagctgtggatccagatacaggaccctggggcgaagtgaaatattccacctatgggactggggcagacctcttcctgatccacccatccactgggcttatctacacccagccctgggctagcctggacgctgaggccactgccaggtacaacttctatgtgaaggcagaggacatggaaggcaagtacagcgtagctgaggtgtttatcacactgctggatgtcaatgaccacccccctcagtttggaaagagcgttcagaagaagacgatggtgctagggaccccagtgaaaattgaggccatagacgaggatgcagaggaacccaacaacctggtggactattccatcacccatgcagagcccgccaacgtgttcgacatcaattcccacacgggggagatctggctcaagaattccatccgctccctggatgccctgcacaacatcacacctggaagggactgcctatggtccctagaggtgcaggccaaggaccggggctccccatccttcagcaccacagccttactcaagattgacatcacagatgctgagaccctctcccggagccccatggctgccttcctgatacagaccaaggacaaccccatgaaggccgtgggtgtgctggccggcaccatggccaccgtcgtggccatcactgtcctcatctccaccgccaccttctggcgcaacaagaagtctaacaaggtcctgccaatgcggcgggtgctccgcaagcggcccagccctgcgccccgcaccatccgcattgagtggctcaagtccaagagcaccaaagccgctaccaagttcatgctcaaagagaaacctcccaatgagaactgtaacaacaacagcccagaaagctctctgctcccgagagctccggctctccctccaccacccagcgtggcgcccagcactggcgcagcccagtggaccgtgcctactgtctctggctctctcactccgcagccgacccaacccccgccaaaacccaaaactatgggaagccccgtccagtcaactctgatctctgagctcaagcaaaagtttgagaagaagagtgtgcacaacaaggcttacttctagtgtatgccctatgaccccccatctttcctccgcccctgacccccaccaccctgctgctcggactatgctccccttcctctgctccttaaggtcactgacccctgttttgcacaatggtataatccccactgtcctcatctctaccgccaccttctggcgcaacaagaagttgcgctctgacagggctctagtcagggccttgggcaagacattgggctctaggatgcaattggcaaatacgtccccgttactcaaatccttggcactactacaatgccctccattcttcagggctgagaattgacgagaagccagctcacccatcccagacctcacagtccctcaggttctactgggatctcatcatcatccttagtcaagcagcagggccctggccacgtggagcaacactgactagaatctggatcctgacgcctgcagctgagagcaggagcaggaaaaggaggctcagcactgtctcaggctggaggtcagcgaacctcgtgggctgtaggaaagcaaatgtaggtaaggggagagcaaggatgcacagaaaacacactgactgtgggactgtgccaggatgcatttggaaagatagagcattctgtctgggcagagactgtggaccctggtatgcccacgtgggacagaggacacagaggtggaagattgatcttgccaagagtgagggcagatgtctccagccaggactgccctgagccgcaaaatgtcaaagctggagctatagaggtagccctaaaggcaactagaagagcatcagggctgctctctgaggagctgccccaccagccatccttgaagagacaattcagggcagttgatgaatatcagggctgagatgtggtgagacttccgtttttatccagctcttttgctcacatcgcgtaaccttgggaaagctgtttaaagtcgctgatcatcctcttcctcatctgtaaatgaagaaagtaggccctgtctacctcacatgcaggtctagggtgaggattgaagaaaatagtggtgatgagggctttaaccaagtgcaaagcggcatgaatgcaaagtatttttctgcagcccagttctgtgggtgcagctcttccagaaagtattaggagcctcacatctactctgccaagcgccccagcaggcactgtgctgggcttaggggctaccactggatgatggcattgccgtgactcacacacctctacttctgttcttccctcactccatccccgctaccgtcctggccagctaccgtcagagagaaccagagctccaagtctttaatttgccaagatgaagaaaatgagttctcaaggagggaatgctttgcttgaggccacacagcaggttggtagcaaagatcttgtctagccagggcagcccttatcagcttgtgacaaccttccccaggacagaagtcatacaaggcctctggggttaatacaaataggttgtgccctgctttaaggaacctgctatcaggaaatctacatgtgtgcacagagagagaaaagtagaacagttctttgcatttggctctacttactaacaacccctctagaatacattggtgatttcatttaaagagattgtatgcatttgtggctttcctgatttctgagtctgtgtttggaggtgttactgagatgtgccagtgtgcagaatccttgctggggtttctacagtccccaacgtgaacagtattaagcaagaggtggactcgagcaatccaggagcccagactgagcaaataagtactttccagcctgtgtttcaggagaggactgtgctggatcatgcttgccctccacagggaatacagcatccttacagcttgcatgcaatcaacctcttttgtaaatggaaaataaagtctgttacccaaaggccatgctgatcccctgctccctgctttcatttatgtttgctgacctgtggagaccagtctttctgacacacagtgaagctcaacttgcctcctggctgcttcagcaggtggatccattcttcgacccccagatgtgactctaaagaaggctgaaaatttttgtccaaattgccatgcagatatcttgaacagcaggacatttgcaggccttgtctactggacttttctcccaaacaggacaagcccaggcagggctgcatggagaggaatggaacctggagctagaattaattgcccactctcccaccctaccagtgcagcccggcaagggcaggaattgggaggcctagggtgggcatgaaagcttgggaagcactgtcgtctctcagacaggcgtcctaaagacctctaggctggaagcttgggcttgcaagtggatccgggaccgagggtggtctcttggacaaccccaggaacttggaccaaggcagagccaatcttgcaaactggccatggatggggaagtgcccggtagccagcatgagccacactaggaaagaggaggagggtgcagccaaacttaaggcaccggcaagtgttgtcagcactggaggagaccccgccagtggggtgaggccagccaagtccctgtgttacgaatggtgggccaaggggctgtctgctaggtcccagtaggacaggcagagctccaggctggcaccatggtaggcctccagggaaagagctgggaggcaggaatggcacactgggcaggcttgcccattcctggccctgagaatggagctgtagcctcatggacaataaatggatgtgacaccaaatactctgcagagtcattttcctcctgcggctgagctcagatcttccaatcacgtgaaataacaaagtcctttacagtttgacagccctaggtctgaattctggttctgccattaattgtgactttgggcaagaggtcaagtctctctgggcctcactttcctcattaacacagggtgcaaagtatggttgcagagaggatgaaaagatctaatatatgtaaagtgcctagcaccggctttgtatctacttacacaagctcagtagacacttgccgtgactgtggcccacatactagaacaccatgtcctgaaagagaggaccccctccatgcatcctcaccccccaggatgtttccacccacctgtaggtccagaagcttttacttcatgctagaaaaagagaagagagtggatccagaggggagtggaggacagggcagatgccacagcatctgtggcctgtgtagccggcagcctgcatttgggcgttgacattccaggggagttaggaacaatgagaggtctctaagaacttgtggcactctgtcctcaagcagctgtccctcagaatcctgctagaaaagtgtgatcagagctgggaaggagccaccatgctctgcttctctaaggatttcggtgattctatttttagggactgaaggcgttgagggaatccaaggccagtccacctgccaggggtgttggcatctgttgacaggcagtggcacatcctgacagtcttcaaggccttggccaccaagggatggagagggagaatggagaagatgccacatgaggaatgaggcaggagactggcatgtgccacatggaggaccccttaggaaactcacaaacaacctagggaggggttctctgaagggcctagtttccagaatgaggcggtcatggcttaagcgaccatcatttgatcaataaagcagagtagcaacaggctgatgttggggacatcggtttgatgttataaaatcgtgcacatgtaccccttttgaggcctgaatgaggttcggttatttattcatttctcaataatttactcagccattcctagggtgacaagtttggagtatatcttctgtgccaggctctcttctaggtgttaggtgtatgtctctaacaagatagaaggaaagaagaaaagaaaaagaacaacattcctctctttaattgctaatcgcctgggcctagggagtcttcattttaaaagcaagtagccctgcttacaaatgtctcctcaatcaaaggcatttgccttaaacttgtatggtctaaactctaaataaataagcttctcaagggcatgacaactata

SEQ ID NO: 112891 - DNA, 4068 bp, Homo sapiens
  Payload ID: 2091
  Gene Symbol: CDHR2
  Gene Name: cadherin-related family member 2
  Uniprot ID: Q9BYE9
  ENST ID: ENST00000261944
  CDS Start-End: 40-3972
gcctccgtggcgaaggggacacaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatagtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagtgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagacggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgc

SEQ ID NO: 112892 - DNA, 4005 bp, Homo sapiens
  Payload ID: 2091
  Gene Symbol: CDHR2
  Gene Name: cadherin-related family member 2
  Uniprot ID: Q9BYE9
  ENST ID: ENST00000506348
  CDS Start-End: 48-3980
tccaggagccattccctgacctcttcccttaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatagtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagtgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagacggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccc

SEQ ID NO: 112893 - DNA, 4509 bp, Homo sapiens
  Payload ID: 2091
  Gene Symbol: CDHR2
  Gene Name: cadherin-related family member 2
  Uniprot ID: Q9BYE9
  ENST ID: ENST00000510636
  CDS Start-End: 275-4207
aaagggggcaggaaccgtcacattgttcagtgatgaaaaccgagggctgcaggagtgcggaccctggaagatcgaggaagacaagtctacccgaatcccccactgtccctccatcttactcgtcctccttccctcacttcccagcccccggcaccagctcgactcgagcttagtggctttcaggcaacggaagctgtgtgaccttgggcaagacacggactctctccggaccccgcagcgttccgacatccagaatgcagtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtgggtgcccaggccttctggttggtagcggaagaccaggacaatgaccctctgacctatgggatgagcggccccaatgcctacttcttcgctgtcactccgaaaactggggaagtgaagctggccagcgctctggactacgagacactctacacattcaaagtcaccatctccgtgagcgacccctacatccaggtgcagagggagatgctggtgattgtggaagatagaaacgacaacgcacccgttttccagaacaccgctttctccaccagcatcaacgagaccctgcccgtgggcagtgtggtgttctccgtgctggccgtggataaagacatggggtctgcaggcatggtcgtgtactccatagagaaggtcatccctagcactggggacagcgagcatctcttccggatcctggccaatggctccatagtcctcaatggcagcctcagctacaacaacaagagcgctttctaccagctggagctgaaggcctgtgacttgggcggcatgtaccacaacaccttcaccatccagtgctccctgcctgtcttcctgtccatctccgtggtggaccagcctgaccttgacccccagtttgtcagggagttttactcggcctctgtggctgaggatgcagccaagggaacctcggtgctgacggtggaggctgtggatggcgacaaaggcatcaatgaccctgtgatctacagcatctcctactccacgcggcccggctggtttgacatcggggcagatggggtgatcagggtcaacggctccctggaccgtgagcagctgctggaggcggatgaggaggtgcagctgcaggtcacggccaccgagacacacctcaacatctacgggcaggaggccaaggtgagcatctgggtgacagtgagagtgatggacgtcaatgaccacaaacctgagttttacaactgcagcctcccagcctgcaccttcacccccgaagaggcccaagtgaacttcactggctacgtggacgagcatgcctccccccgcatccccatcgatgacctcaccatggtggtctacgacccggacaagggcagcaatggcaccttcctgttgtcgctggggggccccgatgcagaagccttcagcgtctccccggagcgggcagtgggctcagcctccgttcaggtgctggtgagagtatccgcgctggtggactacgagaggcagacggcgatggcggtgcaggttgtggccacagactccgtcagccagaacttctccgtcgccatggtgaccatccaccttagagacattaatgaccacaggcccacgtttccccagagcttgtacgtcctcacggtgccagagcacagcgccaccggctctgtggtcaccgacagcatccacgccacggacccagacacgggcgcgtggggccaaattacctacagcctgctcccaggaaatggggcagacctcttccaagtggatcccgtctcagggacggtgacggtgaggaacggtgagctgctggaccgggagagccaggccgtgtactacctgacgctgcaggccacagacggcgggaacctgtcctcctccaccacactgcagatccacctgctggacatcaacgacaatgcacccgtggttagcggctcctacaacatcttcgtccaggaggaggagggcaatgtctccgtgaccatccaggcccacgacaatgatgagccgggcaccaacaacagccgtctgctcttcaacctgctgcctggcccctacagccacaacttctccttggaccctgacacagggctcctcagaaacctggggcccctggacagagaggccatcgaccccgccctggagggccgcattgtgctgacagtgcttgtgtctgactgcggcgagcctgtcctcggcaccaaagtcaatgtcaccatcactgtggaggacatcaatgataacctgcccatcttcaatcagtccagctacaactttacggtgaaggaggaggatccaggagtgctagtgggcgtggtgaaggcctgggacgcggaccagacggaagccaacaaccgcatcagcttcagcctgtcggggagtggtgccaactacttcatgatccgaggcttggtgctgggggctgggtgggctgagggctacctccggctgcccccggacgtgagcctggattacgagacacagcccgtcttcaacttgacagtgagtgctgagaacccagacccccaggggggtgagaccatagtagacgtctgcgtgaatgtgaaagacgtgaacgacaatccccccaccctggatgtagcctcactccggggcatccgtgtggctgagaatggctcacagcacggccaggtggctgtggtggttgcctcggatgtggacaccagtgcccagctggagatacagcttgtgaacattctctgcaccaaggccggggtcgatgtgggcagcctatgctggggctggttctcagtggcggccaacggctctgtgtacatcaaccagagcaaagccatcgactacgaggcctgtgacctggtcacgctggttgtgcgggcctgtgacctagccacggaccccggcttccaggcctacagcaacaatggaagcctcctcattaccattgaggacgtgaatgacaatgcaccctattttctgcctgagaataagacttttgtgatcatccctgaactcgtgctgcccaaccgggaggtggcttctgtccgggccagagacgatgattcagggaacaatggcgtcatcctgttctccatcctccgagtagacttcatctctaaggacggggccaccatccctttccagggtgtcttctcgatcttcacctcctccgaggccgacgtgttcgctgggagcattcagccggtgaccagcctcgactccactctccaaggcacctaccaagtgacagtccaggccagggacagaccttccttgggtcctttcctggaagccaccaccaccctgaatctcttcaccgtggaccagagttaccgctcgcggctgcagttctccacaccgaaggaggaggtgggcgccaacagacaggcgattaatgcggctcttacccaggcaaccaggactacagtatacattgtggacattcaggacatagattctgcagctcgggcccgacctcactcctacctcgatgcctactttgtcttccccaatgggtcagccctgacccttgatgagctgagtgtgatgatccggaatgatcaggactcgctgacgcagctgctgcagctggggctggtggtgctgggctcccaggagagccaggagtcagacctgtcgaaacagctcatcagtgtcatcataggattgggagtggctttgctgctggtccttgtgatcatgaccatggccttcgtgtgtgtgcggaagagctacaaccggaagcttcaagctatgaaggctgccaaggaggccaggaagacagcagcaggggtgatgccctcagcccctgccatcccagggactaacatgtacaacactgagcgagccaaccccatgctgaacctccccaacaaagacctgggcttggagtacctctctccctccaatgacctggactctgtcagcgtcaactccctggacgacaactctgtggatgtggacaagaacagtcaggaaatcaaggagcacaggccaccacacacaccaccagagccagatccagagcccctgagcgtggtcctgttaggacggcaggcaggcgcaagtggacagctggaggggccatcctacaccaacgctggcctggacaccacggacctgtgacaggggcccccactcttctggaccccttgaagaggccctaccacaccctaactgcacctgtctccctggagatgaaaatatatgacgctgccctgcctcctgcttttggccaatcacggcagacaggggttggggaaatattttattaccaatgtatactgtgacagtttgtagccaaaaactgcggctggaggggtggggacgggacactgagtggtcacaagggacttgggctcacagcacaggggggacaaggggctggagagggtggcctttaaaagacaactgtggttatagaatga

SEQ ID NO: 112894 - DNA, 575 bp, Homo sapiens
  Payload ID: 2091
  Gene Symbol: CDHR2
  Gene Name: cadherin-related family member 2
  ENST ID: ENST00000510124
  CDS Start-End: 193-381
agtcggccaggggtgcgtaagggcgcggcgcctggggcctggcagcctccgtgaccttggaggagtgacttcgttttctcgcctgtgaaaagggaaacaatacgaccccatggtcgttcagagaatcttcgcttcccggagagtgtgtcccctcccccagccccggtgggcgcggaggtccctgcggatgtgatggcccagctatggctgtcctgcttcctccttcctgccctcgtggtgtctgtggcagccaacgtggccccgaagttcctagccaacatgacgtcagtgatcctgcctgaggacctgcctgtggtgcaaaatggaatccaggaatgtcgaaagctgccagatgaaacaagagacaccaaggggtattgacaaatacaaaacctgtgcaagcaatcccctgatcaagagaaagtatttccatcaccccagaaagttccctgtgtccagttctagtcaatctctgctccctaaaggtgcccaggccttctggttggtagcggaagaccaggacaatgaccctctgacctatgggatgagcggccccaatgcctacttcttcgctg

SEQ ID NO: 112895 - DNA, 3813 bp, Homo sapiens
  Payload ID: 2092
  Gene Symbol: CDHR3
  Gene Name: cadherin-related family member 3
  Uniprot ID: Q6ZTQ4
  ENST ID: ENST00000317716
  CDS Start-End: 81-2738
ctggaataaactttgggtgtgagacgggattcaggctgtggctaatgtgctggaagcacgcacagttgtgaccatcaagtatgcaggaagcaatcattctcctggctctcctgggtgccatgtcagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaaggtctacacctctacatagtagaaagagcaaaccctggattcatttaccaggttgaggccttcgatccagaagacacaagccgaaacattcccctcagttatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacgaagtccctcgctttaccagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccgccagaacccgagtgggacaggtgcgagccactgataaagacctcccccagagcagcctcctgtactccatctccactggaggggccagcctccagtatccaaatgtattttggattaatcccaagacaggagaactccagctggtaactaaagtggactgtgaaacaacccccatctatattctcagaatccaggccaccaacaacgaagacacaagctctgtcactgttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccaggcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgacaaagaaaggagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacact

SEQ ID NO: 112896 - DNA, 949 bp, Homo sapiens
  Payload ID: 2092
  Gene Symbol: CDHR3
  Gene Name: cadherin-related family member 3
  ENST ID: ENST00000496633
  CDS Start-End: 24-473
acgcacagttgtgaccatcaagtatgcaggaagcaatcattctcctggctctcctgggtgccatgtcagggggagaagcactacacctaatcctcttacctgctacaggcaatgtggcagagaattctccacctgggacttcagtgcacaagttttctgtgaagttatcagcatcattgtcacctgtgatcccaggatttccccagatagtcaactcaaatcccctcactgaagcttttagggtgaattggctgtcaggcacctactttgaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtg

SEQ ID NO: 112897 - DNA, 2633 bp, Homo sapiens
  Payload ID: 2092
  Gene Symbol: CDHR3
  Gene Name: cadherin-related family member 3
  ENST ID: ENST00000478080
  CDS Start-End: 122-2515
gagacgggattcaggctgtggctaatgtgctggaagcacgcacagttgtgaccatcaagtatgcaggaagcaatcattctcctggctctcctgggtgccatgtcaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaaggtctacacctctacatagtagaaagagcaaaccctggattcatttaccaggttgaggccttcgatccagaagacacaagccgaaacattcccctcagttatttcctgatttctcccccaaagagcttcagaatgtctgctaatggcaccctcttctccacaacagaattggactttgaagcaggacacagaagtttccatctcatcgtggaggtgagggacagtggaggcctcaaagcctccacagagctccaggtgaacatcgtgaacctcaacgacgaagtccctcgctttaccagcccgacacgagtgtacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccgccagaacccgagtgggacaggtgcgagccactgataaagacctcccccagagcagcctcctgtactccatctccactggaggggccagcctccagtatccaaatgtattttggattaatcccaagacaggagaactccagctggtaactaaagtggactgtgaaacaacccccatctatattctcagaatccaggccaccaacaacgaagacacaagctctgtcactgttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccaggcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgacaaagaaaggagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatcca

SEQ ID NO: 112898 - DNA, 482 bp, Homo sapiens
  Payload ID: 2092
  Gene Symbol: CDHR3
  Gene Name: cadherin-related family member 3
  ENST ID: ENST00000468477
  CDS Start-End: 1-482
tagactacgaaaatccaagtaacctagcagccggcaataaatatacggtgataatccaggttactgtgaacatccttgaagaaaatgatgaaaagccaatttgtactccaaactcttatttcctggccctcccagtggatctgaaagttggcacaaatattcagaatttcaagctgacatgtaccgaccttgattccagccccagatctttccgttattccattggcccaggtaacgtcaacaatcatttcaccttctctcccaatgctggttccaatgtcacacgcctgctgcttacatctcgctttgactatgctggtgggtttgataagatctgggactacaagctacttgtctacgtaactgatgacaacttgatgtctgacaggaagaaagcggaggctcttgttgagacaggaacagtgacactgagtattaaagtcattccccacccaaccactatcatcaccacgacccccagg

SEQ ID NO: 112899 - DNA, 2358 bp, Homo sapiens
  Payload ID: 2092
  Gene Symbol: CDHR3
  Gene Name: cadherin-related family member 3
  ENST ID: ENST00000466045
  CDS Start-End: 1-957
tacacagtcctggaggaactgagtccaggaaccatcgtggccaatatcacagcggaggatcctgatgatgaaggttttcccagccacctcctctacagcattaccactgttagcaaatatttcatgataaatcagttgactggtacaatccaagtggcccaaaggatagaccgagatgcaggtgaattgagacaaaatcccaccatttccctggaagttctagtgaaggacagaccatatgggggtcaggagaatcgcatccagataaccttcattgtggaagacgtcaacgacaatcctgccacatgccaaaagttcaccttcagcattatggtgccggaaagaacagccaaggggacgttgcttcttgacctaaacaagttctgctttgatgatgacagtgaggcaccaaacaacagattcaacttcaccatgccatctggagtggggagcggcagcagatttttacaggatccagctggctctgggaagattgtgctgattggtgatctagactacgaaaatccaagtaacctagcagccggcaataaatatacggtgataatccaggtgcaggatgtggcccccccttactataaaaataacgtctacgtttatatcctaacaagcccagaaaatgagtttcctctcatttttgataggccatcctatgtatttgatgtgtcagaaagaaggcccgcccagggtcacctatcaggtcctgaggaaaaacgtttactctccatctgcatggtacgtgccgtttgtcatcactttgggctccatattgcttctgggtctcctcgtgtacctggtcgtcctattggccaaagccatccacagacactgcccctgcaagactgggaagaacaaggaacctctgacaaagaaaggagaaacgaagactgcagagagagacgtcgtggtggaaactatccagatgaacactatctttgatggagaagccatagatccagtgaccggggaaacatatgaattcaactcaaaaactggagccagaaagtggaaagatccactaacccaaatgccaaaatggaaagagtccagccaccagggagctgccccacgcagagtcactgctggggaagggatggggtcactgagaagtgccaactgggaagaagatgagctgagtggcaaagcgtgggctgaggatgctggtctgggttccagaaatgagggtggcaagctgggcaacccaaagaacagaaatccagccttcatgaacagggcttaccccaaaccacacccaggaaagtaaacggggtctaaggaggggcctgtcaatcactgagatgctgcctcaccctaaattctatggggatggtgtgggcatggtgtaggggggaaaatgtgggctgaggggattcagacatccagggtcaaacatgggatgtttgacaaatttttaaacaaatagaaaggggtttgatcacatagttgcgtgttctgaaatgatacaggaacattttctatcagatttcagaactacctgtgcttctgataagcaagactgttaactttggggtgtggaattgttgtgtttcttctttgcattgactgctaggaagctctattctgttcaccatagaaagtttgtaggaattcctgacataaatagtgaagactatccttacatctggtttccaccttattttcctgccctcgttttaacatcacccagatttcttcagttataaatatgccatacacctttgtaagtcacctcaaatcttcttcaaaagaagcagaacagtgaaaaaaacagatgagtaagttaagagttggtcatctggaaagaagaaaactcagtaggcaccttcttttgttttttcttgtggtgtccggatcagcatcctgcatgtgagattcatccacgttgtcctgtctagcagtagttcagttctcttcatggttatgtctggtttcattctatgattatatcacaatttatctattctacacttgggtggcagctgcttcagattttttacttttaaaaaatatacttaaaagtgaactacaggcagggcatgatggctcatgcctgtaatgccagcactttgccaaggtgggcagatcacctaaggtcaggagttcaagatcagcctggcctagatggcaaaaccctgtctctactaaaaaatacaaaaattagcttggtgtggtggtgggcacatgtaatcccagctacttgggaggctgaggtagggagaactgcttaaacctgagaggtggaggttacagtgagttgagattgtgccactgcactctagcctgggtgacaaagcaagactccatctcagaaaaaaaaaataaaagtgaattacaacacta

SEQ ID NO: 112900 - DNA, 540 bp, Homo sapiens
  Payload ID: 2092
  Gene Symbol: CDHR3
  Gene Name: cadherin-related family member 3
  ENST ID: ENST00000488386
  CDS Start-End: 170-355
ccgagccagggaagggaccctggtgacctcgcctcccagccctcacccccgtcacccctttcttctctttcctggaggactttggaccatggagattctgcagttgttgctctaggagctgaaaccagtgggtagatgtcgttctgaaacgcaggttgtcaccactgggatggaacaactagattttgaaacaggaccaaacatatttgatttgcagatttatgtgaaggatgaggttggtgtcacagacctgcaagtcctgactgtccaggtaacagatgtgaacgagccacctcagtttcaaggcaacttggcagaagcccgacacgagtgtacacagtcctggaggaactgagtccaggaaccatcgtggccaatatcacagcggaggatcctgatgatgaaggttttcccagccacctcctctacagcattaccacttgactggtacaatccaagtggcccaaaggatagaccgagatgcaggtgaattgagacaaaatcccaccatttccctggaagttctagtgaaggacagac

SEQ ID NO: 112901 - DNA, 1188 bp, Homo sapiens
  Payload ID: 2093
  Gene Symbol: CDHR4
  Gene Name: cadherin-related family member 4
  Uniprot ID: A6H8M9
  ENST ID: ENST00000343366
  CDS Start-End: 24-623
gctgtctgtgtcttcaggtcatcatggtgctgctcaggctcctcgtgttcctctttgctccggtggtctctgacctctgcagcctgccctgctttataaatgtctctgagagccagggccctggcacagtccttcagtttttatccttcaactgctcctcctacacgcccacacccaccctggagttgctcaatgtccagccacccaccaccttcttcaacccacccagcttggccaggtggcaagggacctatgtgggcaagttgaccttgagcagctctgctcagttggatgccctgatggtgaaccactacaaggtgcagctgaagttcacatgtggcaaccatgtgatggagggctcactctctgtggatgtgcagcgggaccttagccatatccagtgtgctggtcaatttgccagcccaggtgaggccaggggcagccggcagggtgggggcaggcatggcctgagcagatcctccctgacctccactctggccagctggggaaatgattcaggtgccagagacagtcacacctggggctcggctgtacactctgctcctcccaggcctagaactccacggagcgcaggtaagcccagaacatgggacggtgggtgacaggatgggggtggggggatggagagaataaattaacccccacctggccaggcacagcctgaagaggaaccttgcagcagaggcatagatgagcctctacatgatgtatgttcttggagagagctgctgagggctgctcactccccagtgaccatggctgttcccacagggacatctcaggggctgagttcttttttttttttttttttgagacggagtcttgctctgtcgtccaggctggagtgcagtggcgcgatctcggctcactgcaagctccacctcccaggttcatgccattctcctgcctcagcctcccgagtagctgggactacaggcacccgccaccacgcccggctaatttttttgtattttgtagtggagacagggtttcaccgtgttagccaggatggtctcgatctcctgacctcgtgatctccccacctcggcctcccaaagtgctgggattacaggcatgagccaccgctcccagccaggggctgagttctttcaagatctgctatgtgttctcagttctttatgacaattctgtatcatttctgtaatc

SEQ ID NO: 112902 - DNA, 2476 bp, Homo sapiens
  Payload ID: 2093
  Gene Symbol: CDHR4
  Gene Name: cadherin-related family member 4
  Uniprot ID: A6H8M9
  ENST ID: ENST00000412678
  CDS Start-End: 10-2376
caggtcatcatggtgctgctcaggctcctcgtgttcctctttgctccggtggtctctgacctctgcagcctgccctgctttataaatgtctctgagagccagggccctggcacagtccttcagtttttatccttcaactgctcctcctacacgcccacacccaccctggagttgctcaatgtccagccacccaccaccttcttcaacccacccagcttggccaggtggcaagggacctatgtgggcaagttgaccttgagcagctctgctcagttggatgccctgatggtgaaccactacaaggtgcagctgaagttcacatgtggcaaccatgtgatggagggctcactctctgtggatgtgcagcgggaccttagccatatccagtgtgctggtcaatttgccagcccagctggggaaatgattcaggtgccagagacagtcacacctggggctcggctgtacactctgctcctcccaggcctagaactccacggagcgcagatgagcattatcagtgcccaggacctgccacacttccctggacctttctccatcaatgagcaaggttggctgcaggcaccatcccagggcctcctaggccaggctcaaaaggtcttccagctgcaaatctcagtgtcctttggacaaaggcaaagctgccaagggatggtgatagtgaaggttttgcctgttccctccagccaggtctccttcctcgagcaggctcagaatatcaccatccctgagaatctggcccccggtagtgaggtggttcaggtccaggcccggggtgtcgacctgcgctatgaaatcctgtctccggtgcccagcccactcttctccattggtcgtgcagacggtgtggtccggaccaccacgcccctagagttagctcgcacctcaggcaccgcggtctccaggctgcaggtgaaggcctttgagcagggccagctgtgggccagtgccaagctcaatctcaccatgaatgtgcagctggtcaacctctggcctccacgctgcctcccagcgcttctggtgtcccaaatcccggagactgcacccgtgggcaccgtgctgaatactctcacttgcgaagatccggactctgttggtgccaccctggactacaagctgtggttccgcagctcttccaaccctgccagcctctgcctttatgacagagtccttgaggtgaatgccacactggactgtgacactcctggagcctgcttccagcatgcagcctccatcctggtgctcgatggtggccagccccagatgaccactgaggtgccggtactggtgatggtgacacccatcaacgagttctccccagcctgtgcccctcgcacgttccgggttcaggaggatgcggcgccccacactctactgggctccgtggtgggcacggatatggattaccctcatgacaacattgagtactacacctctggtggtcctaccacctttgctgtggaccgtctcagcggggaagttcacctcctgggacctttggactatgagcagcagaggctgtacaggctcactgtccttgtgattgaccatggccaagaccagaaccccaaccatcacctctcaggctcctgtaccattaccatcgaggttgaggatgtgaatgaccatgcccccgagtgtgagcccccatttcaggaactcaccatctatgctcctctgggccgtagcgtggaggtgaccaagatgtcatgccagatccctcaggagccacagcgcctgatctactcctatagcatcgtgggagggaatagccagaaccgattcatcctgcaaggggccatcctggtgcacagtgaccttgtgttggggccgttctggccagagcagccccgtacctatgagctactgatctgtgtggccgatgcaggcccctccaccccccacctcagcaccacagccaccattattgtgcatctagttccccggagggccagcacagtggccaccagcacccacagaaccacagtgccctcaacgatgacacccatgctcgtgacagacacagaggctttctggcagccacagccctggtttgtggtggtgttgacagcaactggtgctcttctcctcttggccctaggctggcttcttggcaggctcctccaggggttggcccagctgctgcaagcacccagcaaaccagcccaggctttgctgctaaacagcatccagggaactgagggatccatcgagggtttcctggaggcaccgaagatggagatgtcccaggcacccagcagtgtcatgagtctgcattttgatggcagagcacaggactcccgtaccggaagagactacctgtttaacacacacacaggagcccggcgctggctctgaggccaagtagctgtcttactatgtgtggaatttctttttcacaccatcatgggctgtattttcaagttgattcataataaacaaaattacaaaaagaaaa

SEQ ID NO: 112903 - DNA, 665 bp, Homo sapiens
  Payload ID: 2093
  Gene Symbol: CDHR4
  Gene Name: cadherin-related family member 4
  ENST ID: ENST00000460430
  CDS Start-End: 1-405
caggaactcaccatctatgctcctctgggccgtagcgtggaggtgaccaagatgtcatgccagatccctcaggagccacagcgcctgatctactcctatagcatcgtgggagggaatagccagaaccgattcatcctgcaaggggccatcctggtgcacagtgaccttgtgttggggccgttctggccagagcagccccgtacctatgagctactgatctgtgtggccgatgcaggcccctccaccccccacctcagcaccacagccaccattattgtgcatctagttccccggagggccagcacagtggccaccagcacccacagaaccacagttggcccagctgctgcaagcacccagcaaaccagcccaggctttgctgctaaacagcatccagggaactgagggatccatcgagggtttcctggaggcaccgaagatggagatgtcccaggcacccagcagtgtcatgagtctgcagcattttgatggcagagcacaggactcccgtaccggaagagactacctgtttaacacacacacaggagcccggcgctggctctgaggccaagtagctgtcttactatgtgtggaatttctttttcacaccatcatgggctgtattttcaagttgattcataataaacaaaattacaaaaagaaaa

SEQ ID NO: 112904 - DNA, 554 bp, Homo sapiens
  Payload ID: 2093
  Gene Symbol: CDHR4
  Gene Name: cadherin-related family member 4
  ENST ID: ENST00000487666
  CDS Start-End: 1-454
cagcaccacagccaccattattgtgcatctagttccccggagggccagcacagtggccaccagcacccacagaaccacagtgccctcaacgatgacacccatgctcgtgacagacacagaggctttctggcagccacagccctggtttgtggtggtgttgacagcaactggtgctcttctcctcttggccctaggctggcttcttggcaggctcctccaggggttggcccagctgctgcaagcacccagcaaaccagcccaggctttgctgctaaacagcatccagggaactgagggatccatcgagggtttcctggaggcaccgaagatggagatgtcccaggcacccagcagtgtcatgagtctgcagcattttgatggcagagcacaggactcccgtaccggaagagactacctgtttaacacacacacaggagcccggcgctggctctgaggccaagtagctgtcttactatgtgtggaatttctttttcacaccatcatgggctgtattttcaagttgattcataataaacaaaattacaaaaagaaaa

SEQ ID NO: 112905 - DNA, 1017 bp, Homo sapiens
  Payload ID: 2093
  Gene Symbol: CDHR4
  Gene Name: cadherin-related family member 4
  ENST ID: ENST00000487256
  CDS Start-End: 24-578
gctgtctgtgtcttcaggtcatcatggtgctgctcaggctcctcgtgttcctctttgctccggtggtctctgacctctgcagcctgccctgctttataaatgtctctgagagccagggccctggcacagtccttcagtttttatccttcaactgctcctcctacacgcccacacccaccctggagttgctcaatgtccagccacccaccaccttcttcaacccacccagcttggccaggtggcaagggacctatgtgggcaagttgaccttgagcagctctgctcagttggatgccctgatggtgaaccactacaaggtgcagctgaagttcacatgtggcaaccatgtgatggagggctcactctctgtggatgtgcagcgggaccttagccatatccagtgtgctggtcaatttgccagcccagctggggaaatgattcaggtgccagagacagtcacacctggggctcggctgtacactctgctcctcccaggcctagaactccacggagcgcaggtaagcccagaacatgggacggtgggtgacaggatgggggtggggggatggagagaataaattaacccccacctggccaggcacagcctgaagaggaaccttgcagcagaggcatagatgagcctctacatgatgtatgttcttggagagagctgctgagggctgctcactccccagtgaccatggctgttcccacagggacatctcaggggctgagttcttttttttttttttttttgagacggagtcttgctctgtcgtccaggctggagtgcagtggcgcgatctcggctcactgcaagctccacctcccaggttcatgccattctcctgcctcagcctcccgagtagctgggactacaggcacccgccaccacgcccggctaatttttttgtattttgtagtggagacagggtttcaccgtgttagccaggatggtctcgatctcctgacctcgtgatctccccacctcggcctcccaaagtgctgggattacag

SEQ ID NO: 112906 - DNA, 2318 bp, Homo sapiens
  Payload ID: 2094
  Gene Symbol: CDHR5
  Gene Name: cadherin-related family member 5
  Uniprot ID: Q9HBB8
  ENST ID: ENST00000349570
  CDS Start-End: 268-2223
agtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctgtggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaa

SEQ ID NO: 112907 - DNA, 3635 bp, Homo sapiens
  Payload ID: 2094
  Gene Symbol: CDHR5
  Gene Name: cadherin-related family member 5
  Uniprot ID: Q9HBB8
  ENST ID: ENST00000358353
  CDS Start-End: 324-2861
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctgtggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcatctcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgtttt

SEQ ID NO: 112908 - DNA, 3489 bp, Homo sapiens
  Payload ID: 2094
  Gene Symbol: CDHR5
  Gene Name: cadherin-related family member 5
  Uniprot ID: Q9HBB8
  ENST ID: ENST00000397542
  CDS Start-End: 166-2703
tgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctgtggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcatctcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagt

SEQ ID NO: 112909 - DNA, 496 bp, Homo sapiens
  Payload ID: 2094
  Gene Symbol: CDHR5
  Gene Name: cadherin-related family member 5
  ENST ID: ENST00000531088
  CDS Start-End: 452-496
agtcctagacgccagacccgctcagaccctcctgccagactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaac

SEQ ID NO: 112910 - DNA, 625 bp, Homo sapiens
  Payload ID: 2094
  Gene Symbol: CDHR5
  Gene Name: cadherin-related family member 5
  ENST ID: ENST00000526077
  CDS Start-End: 54-625
agtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcggccgtctgttgcaggacactccgggggagaatgtggaacccagccaca

SEQ ID NO: 112911 - DNA, 550 bp, Homo sapiens
  Payload ID: 2094
  Gene Symbol: CDHR5
  Gene Name: cadherin-related family member 5
  ENST ID: ENST00000534311
  CDS Start-End: 54-550
agtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattgaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccg

SEQ ID NO: 112912 - DNA, 2816 bp, Homo sapiens
  Payload ID: 2094
  Gene Symbol: CDHR5
  Gene Name: cadherin-related family member 5
  ENST ID: ENST00000531177
  CDS Start-End: 31-351
agaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgagaaggctgggccatttcgggatgaagctgcctgggcccacaccctcagcactgaccactgatgatggggaccctgggccagcgcctgcccacttggcctcagtctccccacctgtggggcaggacggtgactgcagacctgtctacatccacaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagactgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggcccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctgtggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccggagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaa

SEQ ID NO: 112913 - DNA, 3489 bp, Homo sapiens
  Payload ID: 2094
  Gene Symbol: CDHR5
  Gene Name: cadherin-related family member 5
  ENST ID: ENST00000617105
  CDS Start-End: 166-2703
tgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgttttaattgtgagagt

SEQ ID NO: 112914 - DNA, 2318 bp, Homo sapiens
  Payload ID: 2094
  Gene Symbol: CDHR5
  Gene Name: cadherin-related family member 5
  ENST ID: ENST00000619215
  CDS Start-End: 268-2223
agtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaa

SEQ ID NO: 112915 - DNA, 496 bp, Homo sapiens; identical to SEQ ID NO: 112909
  Payload ID: 2094
  Gene Symbol: CDHR5
  Gene Name: cadherin-related family member 5
  ENST ID: ENST00000634167
  CDS Start-End: 452-496

SEQ ID NO: 112916 - DNA, 550 bp, Homo sapiens; identical to SEQ ID NO: 112911
  Payload ID: 2094
  Gene Symbol: CDHR5
  Gene Name: cadherin-related family member 5
  ENST ID: ENST00000631535
  CDS Start-End: 54-550

SEQ ID NO: 112917 - DNA, 2816 bp, Homo sapiens
  Payload ID: 2094
  Gene Symbol: CDHR5
  Gene Name: cadherin-related family member 5
  ENST ID: ENST00000631565
  CDS Start-End: 31-351
agaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgagaaggctgggccatttcgggatgaagctgcctgggcccacaccctcagcactgaccactgatgatggggaccctgggccagcgcctgcccacttggcctcagtctccccacctgtggggcaggacggtgactgcagacctgtctacatccacaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaa

SEQ ID NO: 112918 - DNA, 625 bp, Homo sapiens; identical to SEQ ID NO: 112910
  Payload ID: 2094
  Gene Symbol: CDHR5
  Gene Name: cadherin-related family member 5
  ENST ID: ENST00000632059
  CDS Start-End: 54-625

SEQ ID NO: 112919 - DNA, 3635 bp, Homo sapiens
  Payload ID: 2094
  Gene Symbol: CDHR5
  Gene Name: cadherin-related family member 5
  ENST ID: ENST00000633633
  CDS Start-End: 324-2861
attctggggctcgggggatcccggacaccctctcagctcctgcccgggggcccatgtgtcccttctgccctgtgcctcggtgcctgtgacctgagccccctggttgacccctgcactcagtccaacttgggccaaacgactgcccctccttctggcagtgggctggaccagccggccagcgggagcccccttggcagaagccggtcgtaaaggatcataaactgggcggcgtctggctggggcgaaggtcgctgaggtaggaactgcgccagtcctagacgccagacccgctcagaccctcctgccaggtgacagccgccaagatggggtcttgggccctgctgtggcctcccctgctgttcaccgggctgctcgtccgacccccggggaccatggcccaggcccagtactgctctgtgaacaaggacatctttgaagtagaggagaacacaaatgtcaccgagccgctggtggacatccacgtcccggagggccaggaggtgaccctcggagccttgtccaccccctttgcatttcggatccagggaaaccagctgtttctcaacgtgactcctgattacgaggagaagtcactgcttgaggctcagctgctgtgtcagagcggaggcacattggtgacccagctaagggtgttcgtgtcagtgctggacgtcaatgacaatgcccccgaattcccctttaagaccaaggagataagggtggaggaggacacgaaagtgaactccaccgtcatccccgagacgcaactgcaggctgaggaccgcgacaaggacgacattctgttctacaccctccaggaaatgacagcaggtgccagtgactacttctccctggtgagtgtaaaccgtcccgccctgaggctggaccggcccctggacttctacgagcggccgaacatgaccttctggctgctggtgcgggacactccgggggagaatgtggaacccagccacactgccaccgccacactagtgctgaacgtggtgcccgccgacctgcggcccccgtggttcctgccctgcaccttctcagatggctacgtctgcattcaagctcagtaccacggggctgtccccacggggcacatactgccatctcccctcgtcctgcgtcccggacccatctacgctgaggacggagaccgcggcatcaaccagcccatcatctacagcatctttaggggaaacgtgaatggtacattcatcatccacccagactcgggcaacctcaccgtggccaggagtgtccccagccccatgaccttccttctgctggtgaagggccaacaggccgaccttgcccgctactcagtgacccaggtcaccgtggaggctgtggctgcggccgggagcccgccccgcttcccccagagcctgtatcgtggcaccgtggcgcgtggcgctggagcgggcgttgtggtcaaggatgcagctgccccttctcagcctctgaggatccaggctcaggacccggagttctcggacctcaactcggccatcacatatcgaattaccaaccactcacacttccggatggagggagaggttgtgctgaccaccaccacactggcacaggcgggagccttctacgcagaggttgaggcccacaacacggtgacctctggcaccgcaaccacagtcattgagatacaagtttccgaacaggagcccccctccacagatgtccccccatccccagaggctggaggaacaactgggccctggaccagcaccacttccgaggtccccagaccccctgagccctcccagggaccctccacgaccagctctgggggaggcacaggccctcatccaccctctggcacaactctgaggccaccaacctcgtccacacccggggggtccccgggtgcagaaaacagcacctcccaccaaccagccactcccggtggggacacagcacagaccccaaagccaggaacctctcagccgatgccccccggtgtgggaaccagcacctcccaccaaccagccacacccagtgggggcacagcacagaccccagagccaggaacctctcagccgatgccccccagtatgggaaccagcacctcccaccaaccagccacacccggtgggggcacagcacagaccccagaggcaggaacctctcagccgatgccccccggtatgggaaccagcacctcccaccaaccaaccacacccggtgggggcacagcacagaccccagagccaggaacctctcagccgatgcccctcagcaagagcaccccatcttcaggtggcggcccctcggaggacaagcgcttctcggtggtggatatggcggccctgggcggggtgctgggtgcgctgctgctgctggctctccttggcctcgccgtccttgtccacaagcactatggcccccggctcaagtgctgctctggcaaagctccggagccccagccccaaggctttgacaaccaggcgttcctccctgaccacaaggccaactgggcgcccgtccccagccccacgcacgaccccaagcccgcggaggcaccgatgcccgcagagcccgcaccccccggccctgcctccccaggcggtgcccctgagccccccgcagcggcccgagctggcggaagccccacggcggtgaggtccatcctgaccaaggagcggcggccagagggcgggtacaaggctgtctggtttggcgaggacatcgggacggaggcagacgtggtcgttctcaacgcgcccaccctggacgtggatggcgccagtgactccggcagcggcgatgagggcgagggcgcggggaggggtgggggtccctacgatgcgcccggtggtgatgactcctacatctaagtggcccctccaccctctcccccagccgcacgggcactggaggtctcgctcccccagcctccgacccgaggcagaataaagcaaggctcccgaaacccaggccatggcgtggggcaggcgcgcgggtccatgggggtcccattcactcagtcccctgtcgtcattagcgcttgagcccaggtgtgcagatgaggcggtgggtctggccacgctgtccccaccccaaggctgcagcacttcccgtaaaccacctgcagtgcccgccgccttcccgaggctctgtgccagctagtctgggaagttcctctcccgctctaaccacagcccgaggggggctcccctcccccgacctgcaccggagatctcaggcacccggctcaactcagacctcccgctcccgaccctacacagagattgcctggggaggctgaggagccgatgcaaacccccaaggcgacgcacttgggagccggtggtctcaaacacctgccgggggtcctagtccccttctgaaatctacatgcttgggttggagcgcagcagtaaacaccctgcccagtgacctggactgaggcgcgctgggggtgggtgcgccgtgtggcctgagcaggagccagaccaggaggcctaggggtgagagacacattcccctcgctgctcccaaagccagagcccaggctgggcgcccatgcccagaaccatcaagggatcccttgcggcttgtcagcactttccctaatggaaatacaccattaattcctttccaaatgtttt

SEQ ID NO: 112920 - DNA, 2533 bp, Homo sapiens
  Payload ID: 2095
  Gene Symbol: CALB1
  Gene Name: calbindin 1, 28kDa
  Uniprot ID: P05937
  ENST ID: ENST00000265431
  CDS Start-End: 183-968
agggagagaactctggaggaacgctgagctgagcagcaccgaggacagcgcccggcagcgcccgcgcccaggtctccctccgcagccctgactcgcgcacacgctgagcttttgctcactccccctcgcgcggacacagacacacgcatattcacacacccagacacacaccccgctgtacaatggcagaatcccacctgcagtcatccctcatcacagcctcacagtttttcgagatctggctccatttcgacgctgacggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatgtcatactctgtgtaatctctgattaaatttaatatactgcatatcctggtgtctagtttgcatacttcctggattttctttctatgtagaactgttcatttccaccaagggtatctgctgcctctgaaaatatttttttctagctataacaactctattttttactacataattaaattttaatgtaaaattcatagcatcctgattattgaatgttatatcatcaatacttttgtgtattctgtggattctatatttcatattgagatcagcattcaaaatagttctatttctatctgcaaatagtttcaaatgagtttaaaaaaataacatctgaaaagaaatgctaatgtaatcatttatcttatctagcaagaagattctaaaacattctttaacatacatctaagtcagtttcacatatttgtagctagaatatcctatactggttatagttgatatgtaacagttggtgattttagatttctttgattgtgaaacagggagctatgagagatgtgtccatgtgaaatttacagttactgcctaggagttaatgatcgttctgggtcagcttgaatgtccccattctataaattcaacacttattttctgaattcataaaaataaccaaaaaatgtgagctataatgtttccctcaagaacaaacagaaacgagatttgccaaaaactaaaattcaacaaatgatgttgagtgggagattggctttgcctttagcgtgtaaatggaagcactgccattagactgaatttaactactaagaataaataaagaagaaaataaccttaa

SEQ ID NO: 112921 - DNA, 636 bp, Homo sapiens
  Payload ID: 2095
  Gene Symbol: CALB1
  Gene Name: calbindin 1, 28kDa
  ENST ID: ENST00000523716
  CDS Start-End: 280-636
aaagcctgtttggtggtctcttcacatggacgcacatgaaatttggtgccgtgactcagatcaggggacctcccttgggagataaatcccctgtcctcctgctctttgctctgtgagaaagatccacctacgacctcaggtcctcagaccgaccagcccaagaaacatctcaccaatttcaaatctggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaat

SEQ ID NO: 112922 - DNA, 1490 bp, Homo sapiens
  Payload ID: 2095
  Gene Symbol: CALB1
  Gene Name: calbindin 1, 28kDa
  Uniprot ID: P05937
  ENST ID: ENST00000518457
  CDS Start-End: 122-736
aagaaacagatctgcagattatggatctcttactctatcaccaattattattgttgtgatgttgatgtagttggggagatgagaaaacatcttgtcctcactaagggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgatgggaagctggaattaactgagatggccaggttactaccagtgcaggagaattttcttcttaaattccagggaatcaaaatgtgtgggaaagagttcaataaggcttttgagctgtatgatcaggacggcaatggatacatagatgaaaatgaactggatgctttactgaaggatctgtgcgagaagaataaacaggatctggatattaataatattacaacatacaagaagaacataatggctttgtcggatggagggaagctgtaccgaacggatcttgctcttattctctgtgctggggataactagagttggtggccgcaaccacttgctagtgatacactgtatctaaaaaataactgtgcactataagggagtaggctgtattttcttttatatctgtaaatttaactgcatatagataattatccaggatgtgtggctcattcttttcagcttgtttctatactgtttgtaatatacagtttttgtaaccatatgattgaaaagaagaaagtctatgcttaggccagtcagtacacccaattttaaaaaataacatattcttgctttcacaaatatagttgaacaagatttccctaaaaattccaccaggattaatctctaaaattctagtctctgatttgcaaatgcacatttgtcactgaataatggaattatgtataacaagccaaacattcttattttagacaaccatagaactgtcccacaaaatatttctaagcttatttctaactattaggaggaatgtgcttttccatctaaaatactcaccaaaatatagttaattgtggctttatgaagttaacagtctcattacagatttagtttaccaatcaacagcatgtctactgcttggatccatacaaaactatcggttcaagttgatgtgacaagggaagggagcaccagatgacacataaatctgtctgattctatgcctgtatttccaacaaacttactgtcagagaatatgacctaaatccattttctaaactgttttcatgtgttgcaaattattctagtcaactgctgttttatg

SEQ ID NO: 112923 - DNA, 561 bp, Homo sapiens
  Payload ID: 2095
  Gene Symbol: CALB1
  Gene Name: calbindin 1, 28kDa
  ENST ID: ENST00000514406
  CDS Start-End: 553-561
ctgtttggtggtctcttcacatggacgcacatgaaatttggtgccgtgactcagatcaggggacctcccttgggagataaatcccctgtcctcctgctctttgctctgtgagaaagatccacctacgacctcaggtcctcagaccgaccagcccaagaaacatctcaccaatttcaaatctggagcttgctacaagtgccagaaatctgaccaccaggccaaggaatgcctgcagcccaggattcctcctaagccatgtcccatctgtgcgggaccacactggaaatcggactgttcaactcacctggcagccactcccagagcccctggaactctggcccaaggctctctgactgactccttcttggcttagcggctgaagattgatgctgcctcattgcctcagaagccccatagaccatcacggacgccaagcttccggtaactctcacagtggagggaagtggttacctggaaggaaaggagctgcagaacttgatccaggagctccagcaggcgcgaaagaaggctggattggagttatcacctgaaatgaaaact

SEQ ID NO: 112924 - DNA, 548 bp, Homo sapiens
  Payload ID: 2095
  Gene Symbol: CALB1
  Gene Name: calbindin 1, 28kDa
  ENST ID: ENST00000520613
  CDS Start-End: 243-548
cacctacgacctcaggtcctcagaccgaccagcccaagaaacatctcaccaatttcaaatctgcggctgaagattgatgctgcctcattgcctcagaagccccatagaccatcacggacgccaagcttccggtaactctcacagtggagggaagtggttacctggaaggaaaggagctgcagaacttgatccaggagctccagcaggcgcgaaagaaggctggattggagttatcacctgaaatgaaaacttttgtggatcagtatgggcaaagagatgatggaaaaataggaattgtagagttggctcacgtattacccacagaagagaatttcctgctgctcttccgatgccagcagctgaagtcctgtgaggaattcatgaagacatggagaaaatatgatactgaccacagtggcttcatagaaactgaggagcttaagaactttctaaaggacctgctagaaaaagcaaacaagactgttgatgacacaaaattagccgagtatacagacctaatgctgaaactatttgattcaaataatgat

SEQ ID NO: 112925 - DNA, 1466 bp, Homo sapiens
  Payload ID: 2096
  Gene Symbol: CALB2
  Gene Name: calbindin 2
  Uniprot ID: P22676
  ENST ID: ENST00000302628
  CDS Start-End: 78-893
caaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttacccaa

SEQ ID NO: 112926 - DNA, 1373 bp, Homo sapiens
  Payload ID: 2096
  Gene Symbol: CALB2
  Gene Name: calbindin 2
  ENST ID: ENST00000349553
  CDS Start-End: 81-659
gcacaaccccagcgcgagtgccagagcccagccggcgcggagcgggagcggtgcaggctgaggtctccgagcggctcgccatggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccggatagaagcggctacattgacgagcatgagctggatgcccttttgaaggatctgtacgagaaaaacaaaaaggaaatgaatattcaacagctcaccaactacagaaagagcgtcatgtccttggcagaggcagggaagctctaccgcaaggacctggagattgtgctctgcagcgagccccccatgtaaagtggggacgggggctgcttctccacctcccccaaaccctgcttctgctgccctgatgcgtctacccagactcagagaccgtgagcgccccgcccccacccctacagcctgcacacacctgcctgcagagcaggaaatgagagatagaggatgggcagctggggggctgtcctgagccccctgcacccacccctgcccaggcagtctttgctcagtggatcacacacatggaaggtgatgggggcatgggtggagggtccctaattctcttcgctgtgatgcatgagctccctcgctgtatgatttaggcttctatgtccaacagagtggactcttccctctcgctcccctctgccggtcccccatgccaccacccaccccaaacttccaggttccatccaccaccttgccaatggtgtagctgtcctctcagaactcctgtgtgtggaaggcacccgccctttccttgccttctttactcggcgtgctccttttctctttgggtttcttgtttaccaaagaagagtttacagacaataaaatggaaaggtcctgctgtggaaacttaccc

SEQ ID NO: 112927 - DNA, 472 bp, Homo sapiens
  Payload ID: 2096
  Gene Symbol: CALB2
  Gene Name: calbindin 2
  ENST ID: ENST00000490520
  CDS Start-End: 1-472
gctagaaaactttttccaagagctggagaaggcaaggaaaggctctggcatgctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatactcctgcctgtccaggaaaacttcctgcttaaatttcagggcatgaagctgacctcagaggagtttaacgcgatcttcacattttacgacaaggatagaagcggctacattgacgagcatgagctggatgcccttttgaaggatctgtacgag

SEQ ID NO: 112928 - DNA, 704 bp, Homo sapiens
  Payload ID: 2096
  Gene Symbol: CALB2
  Gene Name: calbindin 2
  ENST ID: ENST00000562305
  CDS Start-End: 1-704
tggctggcccgcagcagcagcccccttacctgcacctggccgagctgacggcgtcccagttcctggaaatatggaagcactttgacgcagacggaaatgggtatattgaaggtaaagagctagaaaactttttccaagagctggagaaggcaaggaaaggctctggcatgatgtcaaagagtgacaactttggagaaaagatgaaggagttcatgcagaagtatgataaaaactcagatgggaaaatcgagatggcagagctggcgcagatcctgccaaccgaagagaacttccttctgtgcttcaggcagcacgtgggctccagcgccgagtttatggaggcttggcggaagtacgacacagacaggagtggctacatcgaagccaatgagctcaagggattcctgtcagacctgctgaagaaggcgaaccggccgtacgatgagcccaagctccaggaatacacccaaaccatactacggatgtttgacttgaacggggatggcaaattgggcctctcagagatgtcccgactcctgcctgtccaggaaaacttcctgcttaaatttcagggcatgaagctgacctcagaggagtttaacgcgatcttcacattttacgacaaggaaatgaatattcaacagctcaccaactacagaaagagcgtcatgtccttggcagaggcagggaagctctaccgcaag

SEQ ID NO: 112929 - DNA, 1466 bp, Homo sapiens; identical to SEQ ID NO: 112925
  Payload ID: 2096
  Gene Symbol: CALB2
  Gene Name: Calbindin 2
  ENST ID: ENST00000635371
  CDS Start-End: 78-893

SEQ ID NO: 112930 - DNA, 1373 bp, Homo sapiens; identical to SEQ ID NO: 112926
  Payload ID: 2096
  Gene Symbol: CALB2
  Gene Name: Calbindin 2
  ENST ID: ENST00000635154
  CDS Start-End: 81-659

SEQ ID NO: 112931 - DNA, 704 bp, Homo sapiens; identical to SEQ ID NO: 112928
  Payload ID: 2096
  Gene Symbol: CALB2
  Gene Name: Calbindin 2
  ENST ID: ENST00000635576
  CDS Start-End: 1-704

SEQ ID NO: 112932 - DNA, 472 bp, Homo sapiens; identical to SEQ ID NO: 112927
  Payload ID: 2096
  Gene Symbol: CALB2
  Gene Name: Calbindin 2
  ENST ID: ENST00000634959
  CDS Start-End: 1-472

SEQ ID NO: 112933 - DNA, 7222 bp, Homo sapiens
  Payload ID: 2097
  Gene Symbol: CABIN1
  Gene Name: calcineurin binding protein 1
  Uniprot ID: Q9Y6J0
  ENST ID: ENST00000263119
  CDS Start-End: 128-6790
agccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 112934 - DNA, 2422 bp, Homo sapiens
  Payload ID: 2097
  Gene Symbol: CABIN1
  Gene Name: calcineurin binding protein 1
  ENST ID: ENST00000337989
  CDS Start-End: 219-1991
actttgcccggcagcggtccacagcccgccaccagcggccagtccagggaaccggagaggattggccggcaaaagtcagttgcgctcctgggcccgcttccagtagagtgccggcgccccgtccggccgcgcctgccccgccccggcccgccgcgagcgagagagcgaacgagcctccgcggccatggcccggcgctcgccctagctccactgcacagatgccacggcggagccggcggggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagt

SEQ ID NO: 112935 - DNA, 7480 bp, Homo sapiens
  Payload ID: 2097
  Gene Symbol: CABIN1
  Gene Name: calcineurin binding protein 1
  Uniprot ID: Q9Y6J0
  ENST ID: ENST00000398319
  CDS Start-End: 386-7048
ctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 112936 - DNA, 6952 bp, Homo sapiens
  Payload ID: 2097
  Gene Symbol: CABIN1
  Gene Name: calcineurin binding protein 1
  Uniprot ID: Q9Y6J0
  ENST ID: ENST00000405822
  CDS Start-End: 95-6520
cgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccagaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 112937 - DNA, 1321 bp, Homo sapiens
  Payload ID: 2097
  Gene Symbol: CABIN1
  Gene Name: calcineurin binding protein 1
  ENST ID: ENST00000454754
  CDS Start-End: 251-1321
gtagccgtctgcagggccccagctaagcagcccgcggagagcgagcggcgcgtgcgcccccgctgattggctggcacaaccggcaccggagccaatgggagcacgccttgttgtcaggcgcgcagccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgc

SEQ ID NO: 112938 - DNA, 1472 bp, Homo sapiens
  Payload ID: 2097
  Gene Symbol: CABIN1
  Gene Name: calcineurin binding protein 1
  ENST ID: ENST00000445422
  CDS Start-End: 388-1472
ggctcagcagagcccggggcacaggccggaggggctgcaggcgcgaggctgggttacgtgaggaagctgggggtttcgcgggcagctttagagccccagtcagggaaaccgaggccgggcttcctggctgcctcgcgagcctcttcatggctctcgccgccgccctgaggtgcctagaatgggttccggcctccggggaggttcccagtaaccgcaggagccaccattgatttggcgtctgctgggtgcaaagcccagcgcgctaaccctttactcgcgacctttcgcttcaccttcacagcagccctgcgaggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgtgacatgtcgattcacgatgtttcggtgagtgcagctgagacacaggcgattgtagatgaggccttggggctgcgaaaaaagaggcaagcgctgattgtgcgggagaaggagccggacctgaaacttgtgcagcccattcctttcttcacctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaa

SEQ ID NO: 112939 - DNA, 7072 bp, Homo sapiens
  Payload ID: 2097
  Gene Symbol: CABIN1
  Gene Name: calcineurin binding protein 1
  ENST ID: ENST00000617531
  CDS Start-End: 128-6640
agccggacggcgcggtggtcgggacagactggccgttgctgtggagacgcctggagagttgtggactggggcaacctttgccagtgatgagaagtgatgctcgtggcagtgctgaatctctctgaatatgattcgaattgcagccttaaatgccagctccaccattgaggatgatcatgaaggaagctttaaaagtcacaaaacccagacaaaggaggctcaggaagcagaggcttttgcattgtaccacaaggcccttgatctgcagaaacatgaccggtttgaggagtctgccaaagcctaccatgagctcttggaggcgagcctgctgcgggaggcagtttcatccggtgatgagaaagaggggttgaaacaccctgggctgatactgaaatattccacttataagaacttggcccagctggcagcccagcgggaggatctggagacagccatggagttctacttagaggcagtgatgctggactccacagatgtcaacctctggtataagattggacatgtggccctgaggctcatccggatccccctggctcgccatgcttttgaggaagggctgcggtgcaatcctgaccactggccctgtttggataacctaatcactgtcctgtacaccctcagtgattacacaacatgtctgtacttcatctgcaaagctttggagaaggattgccggtacagcaaagggctggtcctcaaggagaagatttttgaggagcagccttgtctccggaaggactctctcagaatgttcctcaaatgctggaagtgcctcggagagagcttgctggccatgtacaatcatctcaccacctgtgagcccccacgtcccagccttggcaaaaggattgatttgtcggactaccaggaccccagccagcctcttgagtcctccatggtggtgacgccagttaacgtgatccagccaagcactgtcagcaccaacccagctgtggctgtcgccgagcctgtggtctcctacacctctgtggctacaaccagcttcccactgcacagtcctggtctgttggagacaggcgctcctgtgggtgatatttctgggggagataaatccaagaaaggggtaaaacggaagaagatttcagaagagagtggagaaacagcaaagcggcggtctgcccgtgtccgaaacaccaagtgcaaaaaagaagagaaagtagacttccaggagcttctgatgaagttcttgccgtccaggttaagaaagctggaccctgaggaggaagatgattcctttaataactatgaagtccagtcagaagccaaactggaaagcttcccaagcattgggcctcaaaggctgtcatttgactcagccacattcatggaatctgaaaagcaggacgtgcatgagttcctgctggagaacctaaccaacgggggcatcctggagctgatgatgcgctacctgaaagccatgggccacaagttcttggtaaggtggcctccaggcttggcggaggtcgtgctcagcgtctaccacagctggaggaggcacagcaccagcctgcccaacccgctgctgagggactgcagcaacaagcacatcaaggacatgatgctgatgtctctctcctgcatggaactccagctggaccagtggctgctgaccaaaggcagaagctctgcagtgtctcctcggaactgccctgctggtatggtgaatggcagatttggacctgacttcccagggacccactgcctgggtgacctcctacagctgtcatttgcctcgtcccagcgcgacctgttcgaggatggttggctggagtttgtggtccgtgtttactggctgaaggctcgcttcctggcgctgcagggagacatggagcaggccctggagaactatgacatctgcacagaaatgctccagagttccaccgccatccaggtggaggcaggggctgaacgaagagacattgtcatccggctgcccaacctccataatgactctgtggtttccctggaggagattgataagaacctgaagtcgctggagcggtgccagtccctggaggagattcagcggctgtatgaagcaggcgactacaaggctgttgtgcatctgctccgccccactttgtgcaccagtgggtttgaccgggccaaacacctggagtttatgacttccattcctgagaggccagcccagctgcttcttctgcaggactccttgctccggctgaaggactatcggcagtgttttgagtgttccgatgtggctctgaacgaggctgtccagcagatggtgaactcaggtgaggctgccgccaaggaggagtgggtggccacagtgacccaactgctgatgggcatcgagcaggccctctctgcggacagcagtggtagcatcctgaaggtatcatcctccaccactggccttgtgcggctcaccaacaacctcatccaggtcattgactgcagcatggctgtgcaggaggaggccaaggagccccacgtctcttcagtgctaccctggatcattctacaccggatcatctggcaggaggaagacaccttccattctctgtgccaccagcagcagctccaaaacccagcggaggaagggatgtcagagacgcccatgctcccatcctccctcatgctgctgaacacagcccacgagtatttgggcagaaggtcctggtgctgcaattcagatggggctctgctgcgattctatgtgcgagtactccagaaggaactggctgcatccacctctgaagacacgcacccttacaaggaggagctggagacagccttggagcagtgcttctactgcctgtacagcttccccagcaagaagagtaaggccaggtacctggaggaacactcggcccagcaggtggatcttatatgggaggatgcactgttcatgtttgagtattttaagcccaagacccttcctgaatttgacagctataagaccagcaccgtgtctgctgacttggccaacctactgaagagaattgccaccattgtgcctcgcacagagaggccagcccttagcctggacaaagtctctgcctacattgagggaacttcaactgaggtaccctgcctcccagagggggctgacccctcccctccagtggtgaacgagctttactacctcctggctgattatcatttcaaaaacaaggagcagtccaaggccatcaagttctacatgcatgacatctgcatctgccccaataggtttgattcctgggcaggcatggctctggcccgggccagccgcattcaggacaagctgaactccaatgagctgaagagtgatgggcccatttggaagcatgccacgcccgtcttgaactgcttccgtcgggccctggagattgacagctccaacttgtccctatggattgagtatggcaccatgtcctatgccttgcactcattcgcctcacgtcaattgaagcagtggagaggcgagctgccccctgagctcgtgcagcagatggagggccggcgcgacagcatgctagagacagccaagcactgtttcacatcagcagcccgctgcgagggtgatggtgacgaggaggagtggctcatccactacatgctgggcaaggtggctgagaagcagcagcagccacccaccgtttacttgctgcactacaggcaggctggccactacctgcacgaggaggctgcccgctaccccaagaagatccactaccacaacccacctgagctggccatggaggccctggaggtgtactttcggctccatgcttccatcctgaagctcctggggaagcccgattctggggttggtgcagaggtcctggtcaactttatgaaggaggctgcagaaggaccctttgccaggggcgaggagaagaacacacccaaagcttcagaaaaggagaaggcctgcctggtggacgaggactcccactcttcagctgggacactgccgggccccggagcctccctcccctcctcctctggcccaggtctgacatccccaccttacacagccactccgattgaccacgattacgtcaaatgtaaaaaaccccaccagcaggcaacgccggacgaccgaagccaggacagcacagccgtagcactctcagactctagctcaacgcaggacttctttaatgagcccaccagcttactggaaggctccaggaaatcctacacagagaagaggctgcccattctcagttcccaagcaggagcgacgggtaaagatcttcagggggccacagaagaaagaggaaaaaacgaggagtcattggagagtacagaaggcttccgggctgcagagcaaggtgtccagaagcctgctgcagaaaccccagcctctgcttgcatccctggcaagccctcagcatccacacccaccctgtgggatgggaagaagagaggggacctcccaggggagccagtggccttcccccaggggctgccggctggtgctgaggagcagcggcagtttctcacagagcagtgcatcgcctccttccgcctgtgcctgagccgcttcccccagcactataagagtctctaccgtctggccttcctctacacctacagcaagacccaccggaacctccagtgggcccgcgacgtgttgctaggcagcagtatcccgtggcaacaactgcagcacatgccggcacaggggctcttctgcgagaggaacaagaccaatttcttcaacggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttggggctgccgcccagagacaggcctcgggggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagagggagaagagctggcgagagtggcagagggcaccagcttcccgcctcaggagccacggcacagtccgcaggtgaagatggcccccacaagttccccggcagagccacactgctggccggcagaggctgccctgggcacaggcgctgagcccacctgcagccaggaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagtt

SEQ ID NO: 112940 - DNA, 2253 bp, Homo sapiens
  Payload ID: 2097
  Gene Symbol: CABIN1
  Gene Name: calcineurin binding protein 1
  ENST ID: ENST00000620406
  CDS Start-End: 53-1822
gaacgagcctccgcggccatggcccggcgctcgccctagctccactgcacagatgccacggcggagccggcggggcatctggcggatccccgtggacgagattgaccggccgggcagctttgcctggcacatgaaccgctccatcgtgctgctgctcaaggtgctggcccagctgcgggaccacagcaccctgctgaaggtgtcctccatgcttcagcggaccccagaccagggcaagaagtatctgcgagatgctgaccgccaggtcctggcgcagcgggccttcatcctcactgtgaaggtgctcgaagacacgctgagcgagctcgcagaggggtcagaacgcccagggcccaaggtctgtggcctccccggagccaggatgaccaccgatgtctcacacaaggccagtcctgaggatggccaggagggcctcccccagccgaagaagccccctctggctgatggctcagggccagggcccgagccaggaggcaaagtgggcctcctcaaccaccggcctgtggccatggatgcaggagacagtgcagaccaaagcggggagcggaaggataaagagagcccacgggcagggcccactgagcccatggacacgagtgaggccactgtttgccactcagacttggagcggacaccacccctgctgccaggtcgccccgcaagggaccggggccccgagagccggcccactgagctgtccctggaggagctgagcatcagtgcccggcagcagcccaccccgctcaccccagcccagccagcccccgcccccgcccccgccaccaccacagggaccagggcagggggccacccggaggagccgctctcccggctcagccgcaagaggaagctcctggaggacacagagtcaggcaagacacttctgttggatgcctaccgtgtgtggcagcagggccagaagggtgtggcctatgacctgggccgtgtggagaggatcatgtcggagacctacatgctcatcaagcaggtggatgaggaggctgcgctggagcaggctgtgaagttctgccaggtccatcttgggctgccgcccagagacaggcctcgggacacccccaccactccaaagcaccccaaagacagccgagagaacttctttcctgtgacagtggtgcccacagcccctgaccctgtgccagctgactctgtccagcggcccagtgatgctcacaccaagcctcgccctgcactagctgccgccacaactattatcacctgccctccgtcagcatcagcttccaccctggaccagtccaaggaccctgggcctccccggccacacaggcctgaagctacccccagcatggcctctctgggcccagaggggaaactgaggcctgagccgagaagggatggggaggctcaggaggctgcgagtgagactcagcccctgagctctcccccaacagctgccagctccaaggcccccagcagtgggagtgcccagccaccagagggtcacccaggcaagcctgagcccagccgggctaagtcccgccccctgcccaacatgccaaagctggtcatcccctccgccgccaccaagttcccccctgagatcaccgtcacgccacccaccccaaccctgctctcccccaaaggcagcatctcggaggagaccaagcagaagctgaagtcagccatcctttctgcccagtctgctgccaacgtgaggaaggagagcctatgccagccagccctggaggtcctggagacatccagccaggagtcctcgctggagagcgagacagacgaggacgacgactacatggacatttgaggggccactgcagccccaccgccacgccccaggggaccagccaggcctggaatgccccctgggcaggaccctgggcaggaccagaggcccacatggatgccactccccacacagcccccaggcctgcccagcccacctcctcatggcatcctccctgtacccaggtcaggctgtccacaccacatgggagcccagaggaggaggggcccgccttagccatgtgaaggtggattggtcgccatctgcacgccaggcggcatccttttctatgaagtgttgactttgtaaatctgcccacacccagctggccatatccacccctcgacgccgggatgagccggctctgcctgtgtcacagtggaggggtcctttagggccaggctcacccctcaccctttttttggttgcttttctaataaagatggaacagt

SEQ ID NO: 112941 - DNA, 3329 bp, Homo sapiens
  Payload ID: 2098
  Gene Symbol: CHP1
  Gene Name: calcineurin-like EF-hand protein 1
  Uniprot ID: Q99653
  ENST ID: ENST00000334660
  CDS Start-End: 241-828
cattcggggctggaactcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagcaaagctctttcaccagatgtagactgtagccctgctgccttccctccagcgagtctgccagcatgcttcttcatcctttttatatgttctttgcttcctacttccctgtcttccaacatactgttcacttactctggcagtctttctgcttttcattaagcctcaaaatctcctctgttctacttggcaccacaagctatgtcctatatatgtatttctgacttggcaggatagttcaggggtctggcagtttttatttaccttcattattaaatgggcctctgggatgttgcctcttcaggagctttttggtaatcaatacttctctcagaagtatgagaccatcctctgcactctgctctgtcatcaaaggctgctgggtggagataccctttttgaaaggtggccttggtgagaggtatggagccaagtcttctaggttgcttgcccacatcactctatctctggcctctgattctcaactttgtacctgtgtggctcctcttgttagtgcaatgttgactgttgaaaaagcagcagtatgcttacaggtttgcttagtttggggacaccgttaccaccagaatggctgctctgacaatatgcctagggactttctcatggcttttatttaataaggaggctgggcaccctataaagcctcatgcattcacacctttgcagcatggtttatgcctcagtgttatgtgcactggaatgttttccacttcacatttccaagtagaaatattagtgttacggaagtgcctaatatcccagtccaaatttttttttttttttttttttttttttgagacagagtcttgctctgtcacccaggctggagtgcagtggtgcgatcgctcactgcaacctcagcctcctggatttaagtgattctcctgcctcagcctcccaagtagctgggattacaggtgtgcaccaccatgcccggctaattttttgtatttttagtggagacagggtttcaccatgttggccaggctggtctcgaactcctgacctcgtgatccgcctgcctcagcctcccaaagtgctgggattacaggtgtgagccaccacgcctggccccagtccaaaatatttaaagattgtttccttagtgtcttgaagttttgcacaaaattcttttttttgagatggagtctcactctgtcacccaggctggagtgcagtggcgtgatcttggctcactgcaacctctgcctcctgggttcaagcaattctcccacctcagcctcccaagtagctgggattacagacgtgtgccaccatacctgggtaatttttgcatttttagtggagagggagtttcaccatgttggccaggttggtcttgaactcctgacctcaggtgatcctcctgcctcggcctcccaaagtgctgggattacaggcatgagccaccgtgctcagccgcaaaattctttatgaattttacacttggcaaatgttaatgacggaagccatagtctgctcctaatacatgtccaaagcattgactgttgtgtcattagctgcctggttacattagctccctggcttcttgtttagaccactgctaatcccttaaaaacaagaggtctggcactagtagcacaacctaaggtggcattacagatctttgagcgagccacagcaacttttctgccaagtcagcttagtttagacttcagtgaatcaggctattgctatcctaatgtatgtctctatgagtgtatttagccacacatctgcccttggttgactttctgactcattgcttgcttgcttgtttccttgctttggaaaactattgaagattgctaaaaaataccactgcaaagtgatggaaaagggtggagaacaggggagtagccaggctggatggctcaaatataaatgaatgaggaattctttatgaagtatcagtcagattttatgattaagtgatgtaatataggaattatgtaaaagggaagaatgtctgatactgatctattagagaggtactttagaggcttcttgattggcataaagttcctaaggttatagattttccccccttttggctgtatagcaaagtgttttaatccacggttgtgccttattgttccattaaaattgtatcttcgatccatcaataaatacttgtggttgaaacaaaataa

SEQ ID NO: 112942 - DNA, 1000 bp, Homo sapiens
  Payload ID: 2098
  Gene Symbol: CHP1
  Gene Name: calcineurin-like EF-hand protein 1
  ENST ID: ENST00000392151
  CDS Start-End: 145-531
accacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactgtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagc

SEQ ID NO: 112943 - DNA, 717 bp, Homo sapiens
  Payload ID: 2098
  Gene Symbol: CHP1
  Gene Name: calcineurin-like EF-hand protein 1
  ENST ID: ENST00000560784
  CDS Start-End: 162-533
gccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcacttagaggaagagagatatatatagagagagatcgagactgaaattgagcaacactcctcccaagcatggaatttgcttttcgactatatgatttggataaagatgaaaagatctcccgtgatgagctgttacaggtgctacgcatgatggtcggagtaaatatctcagatgagcagctgggcagcatcgcagacaggaccattcagga

SEQ ID NO: 112944 - DNA, 1088 bp, Homo sapiens
  Payload ID: 2098
  Gene Symbol: CHP1
  Gene Name: calcineurin-like EF-hand protein 1
  ENST ID: ENST00000560411
  CDS Start-End: 244-405
attcattcggggctggaactcgaacgctgacgttggctcctgagccgggcgctgcctcgcgcctgattggcgggtcctcggggccgccctccccagcgcaccacccctgggttccctcccgggtccgcagtggaaacactgccctctcccttcttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggctccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggtgctacgcatgatggtcggagtaaatatctcagatgagcagctgggcagcatcgcagacaggaccattcaggaggctgatcaggatggggacagtgccatatctttcacagaatttgttaaggttttggagaaggtggatgtagaacagaaaatgagcatccgatttcttcactaaaggagaccaaactgttccttgcggtctagtatttaagaactggaacttgaaagtcctccttctaccaactccacctccaccccctcattccccttctcccaaagtactactgctgttgcatgacaaccccaaatatgttctgtcaacacaaacctgcctttggtgtataaacagggcattacagaatggtacaccctatatatttctgttcagtatccattcactagttcttcatttataaatatcatcttccccattctgctgctgaatgccacacatccatccagtctgagaaagtgagagaggcaatcatgccaagaacaagccagc

SEQ ID NO: 112945 - DNA, 467 bp, Homo sapiens
  Payload ID: 2098
  Gene Symbol: CHP1
  Gene Name: calcineurin-like EF-hand protein 1
  ENST ID: ENST00000560965
  CDS Start-End: 1-274
ccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacagtagagacggggtttcagcatattggccaggctggtctcgaactcctaacctcaagtgatccacccacctcggcctcccaaagtgctgggagtacaagcacgagccatcatgcctggccccaactgtccattttaaatatgtacagcttattgtatattatttatacttcaataaagatagttactcttctccccaa

SEQ ID NO: 112946 - DNA, 568 bp, Homo sapiens
  Payload ID: 2098
  Gene Symbol: CHP1
  Gene Name: calcineurin-like EF-hand protein 1
  ENST ID: ENST00000560397
  CDS Start-End: 91-555
ttgacccctagcccttccttccctccctccttccctcctgtcgccgtctcttctggcgccgctgctcccggaggagctcccggcacggcgatgggttctcgggcctccacgttactgcgggacgaagagctcgaggagatcaagaaggagaccggcttttcccacagtcaaatcactcgcctctacagccggttcaccagcctggacaaaggagagaatgggactctcagccgggaagatttccagaggattccagaacttgccatcaacccactgggggaccggatcatcaatgccttctttccagagggagaggaccaggtaaacttccgtggattcatgcgaactttggctcatttccgccccattgaggataatgaaaagagcaaagatgtgaatggacccgaaccactcaacagccgaagcaacaaactgcactttgcttttcgactatatgatttggataaagatgaaaagatctcccgtgatgagctgttacaggttttggagaaggtggatgtagaacagaaaatgagcatccgatttcttcactaaaggagaccaaact

SEQ ID NO: 112947 - DNA, 2382 bp, Homo sapiens
  Payload ID: 2099
  Gene Symbol: CHP2
  Gene Name: calcineurin-like EF-hand protein 2
  Uniprot ID: O43745
  ENST ID: ENST00000300113
  CDS Start-End: 424-1014
caggtctcccaggcttcctcagcgtcgacgccggggagcgccctggggttgggagcgcccggggcccgcgaaggaggaggtggctcaggtgtcagggcgcaccgtgggaaccggccccgggggaggcgtggaaacgcggggcctgggactcgaccagcctctcccgtgcggatcgcaaaatctcggagctgaaacagcccgttgttcgcagcctccctctgacccgccaccctgcacattgttttccattcgcccgggtcgcgggtgggaggagaggcacgccggggttctggagcttggccgcgcgccaggcttgtggccttcgtccccctggggccactggggcggccacgcctctccggcgggaggagagaacgcgtgggtccgggtggctgctccggcccttccgcctccagctcggccatggggtcgcgcagctcccacgccgcggtcattcccgacggggacagtattcggcgagagaccggcttctcccaagccagcctgctccgcctgcaccaccggttccgggcactggacaggaataagaagggctacctgagccgcatggatctccagcagataggggcgctcgccgtgaaccccctgggagaccgaattatagaaagcttcttccccgatgggagccagcgagtggatttcccaggctttgtcagggtcttggctcattttcgccctgtagaagatgaggacacagaaacccaagaccccaagaaacctgaacctctcaacagcagaaggaacaaacttcactatgcatttcagctctatgacctggatcgcgatgggaagatctccaggcatgagatgctgcaggttctccgtctgatggttggggtacaggtgacagaagagcagctggagaacatcgctgaccgcacggtgcaggaggctgatgaagatggggatggggctgtgtccttcgtggagttcaccaagtccttagagaagatggacgttgagcaaaaaatgagcatccggatcctgaagtgactccgtttgtgccttgggcttgctcctgcaaccagtatctccttggaattcatccaaagcccccatggacgcatggacgcagggcgacaataaactgtattttcgtttctaactctatttagggccaagagaagaaagctggaaggatgtgtactaaagtctagctcagcagtccccaacctttttggcatcagggacagtttttccacggatgggtgacaggggatggttttgggatgattcaagtgcattacatttattgtgcactttatttctattatgattacattgtaatatataatgaaataattatacaactcaccataatgtagaatcagcaggagccctgagcttgttttcctgcaattagacggtcccatatgggagtgatgggagacagtgacagatcatcaggcattagattctcataaggagtgcacaatctagatcctttggtgtgcagttcacagtaggatttgggctcctatgataatctaatgccactgctgatctgacaggaggcagagctcaggcggtaatgcaagcaatggggagtggctgtaaatatagatgaagcttcagctcgcctgccgctcaccttgtgctgtgcagcccggttcctaacagaccacagaccccacaccaggtctatctcatttggtctcagagctgtgaatcagccagcaatattttagttgcaaatcactgaaaacccaactcaaagtgacttaagtcagaaagaaattttatgaattcaggtaattaaaaagtccagaagtatctgcctttaggcacagctggatccaagggcacaaatgatgtcatcaggctccagttattctccatctcccagctcagctttttctgtctgtaagcctgattttcaggaaggctctttcctagtgatggagatgaccaccatcagctccaggcttctatcctgctaacccagtaacccagtgggaagagatttacttattccaataattccaagtggagagtgtcattgacccgtttggggtctcatctctacttctaggggaatgaaacactctgagtggccaggcctgtgtcatgtgctaattcctagagccagggaaataaggtctgaggattcaggatggggtgaaaggtggttgcttaaaggaaaatgaaatacaattagcagaataaggggaaacgagtggtctgctctgctcgggcaaaacaagagatgcccattactgtgagggacccttgaagtctggactcttaaatgggtttttgctgatttcctgggtgcatgctaggatgatggggcttgatgcagtagggaagagacgatgtaaaaataataaacaatatataccttcctagagtgtgaatgca

SEQ ID NO: 112948 - DNA, 1898 bp, Homo sapiens
  Payload ID: 2100
  Gene Symbol: CPPED1
  Gene Name: calcineurin-like phosphoesterase domain containing 1
  Uniprot ID: Q9BRF8
  ENST ID: ENST00000261660
  CDS Start-End: 76-444
agcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaacta

SEQ ID NO: 112949 - DNA, 6273 bp, Homo sapiens
  Payload ID: 2100
  Gene Symbol: CPPED1
  Gene Name: calcineurin-like phosphoesterase domain containing 1
  Uniprot ID: Q9BRF8
  ENST ID: ENST00000381774
  CDS Start-End: 242-1186
tagacagtctccactcgccaggcgcgcaggtcgatcccagaggggccgctggcgcctccgctccgcccaggcagcactagtggcgccccgagccaccgggcccctccccgtcccgccccagtcccgccccgagatcaaagggcgtcgcccaaagcgggacaggtccagcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccagggaagccgtggcggacggagcagacggaggacctgaagcgagtgcttagggcagtggacagggccatcccactggtccttgtcagcggcaaccatgacattggcaacacccccacggccgagaccgtcgaggagttctgccggacttggggagatgactacttcagcttctgggtcgggggcgtcctgttcctggtcctcaactcccagttctacgagaacccctccaaatgccccagcctgaagcaggctcaggaccagtggctggacgagcagctgagcatcgcgaggcagcggcactgccagcatgccatcgtcttccagcacatcccgctgttcctggagagcatcgacgaggacgacgactactacttcaacctcagcaagtccactcggaagaagttggcagacaagttcatccacgcaggtgtcaaagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaactagaacgctcttcttttagtgttttgctgaaatcctgttttgtatttgtttctttacaacaggtgtaggtataggaggtcaagaaaaggagttcggtaaagggcatagctaataacaaccacacattgggccaggcacagtggcttacgcctgtaatcccagcactttgggaggctgagacgggcagatcacctgagatcaggagtttgagaacagcctggccaacatggtgaaactccatctctactaaaaatacaaaaattagccaggcatgctggtgcacacctgtaatcccagctactcgggaggctgaggcaggagatcgctggaactcaggaggcagaggttgcagtgagccaagatcatgccactgcactccagcctgggcaacagagcaagactctgtctcaaaaaaaaaaaaaaaaaaccacacacacacacattgagacttgagatgtggtgacacttggatcataaacagagggcttcgattccaggatgggggttcctccagggggaaatgaaaaggagctctcactctgttcttacgtatgcacaatgctctgaattgtggcacatgggtttgcagaaggataatggagataattgaaagtaatgaaaatgaaaccaaatctccttccccaaaaacttaaaagaactgattcaaaagtaccccaagaatatgcaaagaaaagggaatcacatcaacagatgattggataaagaacatgtggtatgtatacataatggaatactattcagccactaaaaagaatgaaaccatgtcttttgcagcaacctggatggaactggaggctgttatcttaagtgaaataacttagaagtagaaagtcgaatacttcatgttctcactcataaatgggagctacataaagtgtacccatgaacatagagtgtggaacaaacattggagactcagaagggtgggaggagggtaagggatgagaaagtacctgatgggtacagtgtacacttttctggtgttggttgcaggaaaagcctggacttcaccacttcgcaatatatccgtgtaacaaaactgcacttgtacgccttatatttatacaaatttaattttttaaaagggaagagagaatcatattaatttctcaccactttttaagtaagcaaacagcagtatttcccagaggcaagaggttcagcaagaagtcaggaaatgtttttgtagataagcatctatcattctgatgggccatgactagtgtgttcacttgtaattcctttgcctttaaaaaaagagaatgatatcaaaaaataagtgccttatactgtgaaaaacgataaaaggacttcctgattctaagtgctatggttttgaatgtttattatgtgttttaagtgctttggctcagaaaggtgggggtcacgtggccaaggtcgcctaactcatcttggtggagaaagaacggatgtagatggcccaaggcttgagtccatgctccataacactgtcctgtcttggaaaacgtttctcagaggtgaaaggttgcaccagctcagccagtggcaacacactgagtacggtattcagcaccttggacagcgttagctggaggcccagggatttcctcccagctctgcaaagcctagaccagaccctgattgcaccaggttcagggggcagaagcttgtccaaagagcagatggttccagggggaggatttttactgggggagatttagaaaccgaactgaaccataatgagtcacgggacacagccctgtctgcagcagtaactgtccgcagctctagctgctccatgtctggagttaccaccacagggtgtaggaaaccaccagctgtctcaaggcaaggaatgtcacctaatgctcccctttccaattaatcactttaattggaggaaaaaacaaaaacacaaggacatgttacgggggaaggttttttaaagtgatctcaaattggattgcaaaggctcaagtgactttgggaatggggctggggagatgatcatttactttttacaataaataattttatctcacatctttagtcaagtttctcctaagtttggggagaatggggaaaaaatgtagtaagctttatgggactagcaacagaacgttttatcctattttgtgattttcagtattaagagattattgatcacttgcagagttacaaggcaagcactagtttaaatctgaattagactagggccattgaccttatatacctgtaaaagacactacggtgtatacaactgtagaaacaatatacacatagtagtttaatattacagtctgtattccaatgcagaatcttttgagaaaaggttgccaaaacatcatttgcatttacttgaacccttttttagacagaatcttgctctatcacccaggctggagtgcagtggtgtgatcacagctcactgcagccttgaactcttgggctcaaccaaccttcccacctcagcctcccaaattagctgggactataggctcgtgtcaccacatctaattttttatttttatatttgtggagttgaaggtcttgctctgttacccaggctggtcttgaactcctggccccaagcagtccttccaccttggcctcccaaagtgttgggattacaggcgttggccactgtacccagccttacttgaactcttaatacttattcccaagtggtacctaaaatggttttgtgcagtcacaatattaggtagcaatattatattgagctggaggaaaaagaagatttaggagtaaattgccaaggcaagttctgttaaaagctttctgtaatagacatcagggattttttttattcaggtaacctcaacagttttgattgcacatgtaacatagtacttgacaggtaatactgatttttataacttcataaaatattctcaagccatggaggagctcttatgtattttttaatgagtacacacacacacacacacacacacacacacacacacatatagtaaaagtggaggattcttttcttggaataatgatttctagcatttatctagaaaagattttgctgactaaattttccttttcctccagtggatttttaaacatcagtgcatgcacataaatacagattggatttttcctttaggctttatctatgtaaatgaagtcgattaaatgtgaataatcatgttacccttcattattctgaccattatgtttgagaagtagatttcttcactaaaggggctttgcagcacacttagaatgagtgagccactgtgcctctctagaaactggcttcttgtcatcatttcaacatccactcaaacgctcacccctgaaagtggccttcctgcttgatatggtttggctctgtgtctccacccaaattggtttggctctgtgtccccactgaaatctcatctcgaattgtaatccccataatccccatgtgtcaagggacggacctggtgggaggtaattggatcatggaggcagtttctcccatgctattcttgtgatagtgagttctcatgacactgatggttttgtgtttgatagctccttcacactctttctttcctgttgccatgtaagacatgcctgcttccccttccaccaggattgtaagtttcctgaggcctccccagccatgcggaactgtgagtctattaaatctcttttctttgtaaatta

SEQ ID NO: 112950 - DNA, 1993 bp, Homo sapiens
  Payload ID: 2100
  Gene Symbol: CPPED1
  Gene Name: calcineurin-like phosphoesterase domain containing 1
  Uniprot ID: Q9BRF8
  ENST ID: ENST00000433677
  CDS Start-End: 76-594
agcggttgttctgtgtgaagtcgcgcggcttccacccacgcagtgttctaagtgaaggccagaaactcgctcgccatgtcggctgcagaggcggggggtgttttccacagagccaggggcaggaccctggccgcgtttcccgcagaaaaggaaagcgaatggaaaggcccattctacttcatcctgggcgcagacccacagtttgggctgatcaaggcctggtccactggggactgtgacaatggcggtgacgaatgggaacaggagatccgtctaactgagcaagccgtccaggccatcaacaagctgaaccccaaacccaaattcttcgttctgtgcggcgacctcatccacgccatgccaggtgtcaaagtcgtgttctcaggccactaccacaggaatgccgggggtacctaccagaacctcgacatggtggtgtcatctgccattggatgccagctgggcagagacccccacgggctccgagtcgtggtggtcaccgccgagaaaattgttcaccgatactacagtctagatgagctgagtgagaaaggaatagaagacgatctcatggatttgatcaagaaaaaatgacgctccttcccgttcccgttcacttttcacttgcactatttttttattttgccagaaacagcagctgcacacaacctcttgctgaaatataaaaatagcccaggcaggtttgtgaatttatgtccttttgcataaatcagagagctggggccctgtcctgaattatattcaaaatagaactgcatttcctttaaaatggagcgaatgatcctggaaatcagtttttaaaatattagactatctctgcatggatgtttgaataaattctcctaatgctgtgtttctcaactccacttttgaattggattgtattctggttagcatatggtcaaagtctgcctatcgacctcaattccaatctgacagccaagtatgatctttgataattccttaaacaaactacacctgattgtattaaattgtggtcacgattcccaaaacgctaggcaaaacaaagttcatctcctttcctttccagcggaacgaacagctgtctcccttgttgtgagagccatgcagacttattttgacaaggagccaagtaggcaccatttactgttcaattctgagacttctgatgataggaacagaatgcagttgatacagctcggagcttaaatttgccttcctgggtgcctagaaaagtcacctttgcacataaattggccatttctgaaaatctcctccaagagactgaaaccaaagctctaaaacgccgcttcttcagtctctggggagcacgttgagttggttcacatccacattctggctgtgtagccactccacagatgggtggtctcttgggatcagaatgcccctccactcatgagactcttcattttgtccactttgacaggaaaagtgggaatgtatgcagagctctcaaaagaaacaaaaaaggccaaaacggtgccttcagccacatcctctgaattggccctgacttggactaaatgcactaatgcaaaatcccttgacaaaagcgcataggttatttcaaaccagcattgttttttatgtaacctgttttaccgcatcttctcagcagcttctgaccactgctcaattttctcctttacagccattgttctggtggacaaataacctaggtactccaaatcctggcaggaaaaatatacagcattatgaaacagcactcagtaatcctaaaatgatttccaaagctggttacacatgacctgcaaagtctattaaattaaaagactttctcattacagagtttagtcaacgtagcaaaaccatgggaaattaaatggaaagataattaaatatgtaaattcataaggaacaaaagacgagaagttaattatacaataggctggtgacaccagagttcattgttatgtgccacaagaaaattaaattttttaaaaaacta

SEQ ID NO: 112951 - DNA, 3696 bp, Homo sapiens
  Payload ID: 2101
  Gene Symbol: CALCR
  Gene Name: calcitonin receptor
  ENST ID: ENST00000359558
  CDS Start-End: 301-1827
agcttcacagctgggagagcgcaggaaggcgccgggaaggaaagccagcccaccagcgtctgggtgggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccagaataaatgattcccactgatccacccacttttgccaccccaggatgcaattttctggagagaagattagtggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatcttttcattc

SEQ ID NO: 112952 - DNA, 1502 bp, Homo sapiens
  Payload ID: 2101
  Gene Symbol: CALCR
  Gene Name: calcitonin receptor
  ENST ID: ENST00000360249
  CDS Start-End: 33-521
ttctaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattcttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctg

SEQ ID NO: 112953 - DNA, 1774 bp, Homo sapiens
  Payload ID: 2101
  Gene Symbol: CALCR
  Gene Name: calcitonin receptor
  ENST ID: ENST00000394441
  CDS Start-End: 317-1741
agttataagagacaggaataccagtgagaagtatgagagagtgggtgggagataatgtttagaatctcttttgctgcccgcaatttatgaaaatggcttgaaaatatttatggtcaaagaccgaaatatttcttcaaagaagattagctttgctccattaaaagtaatgagtagaaatattaaaaaaaaaaaaagttttaagtacctgagtatcttgccagcaactgaccaccactgctaaaagtgaggagagacacagctttcatcattgggactgcagtttatttcaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgag

SEQ ID NO: 112954 - DNA, 1741 bp, Homo sapiens
  Payload ID: 2101
  Gene Symbol: CALCR
  Gene Name: calcitonin receptor
  ENST ID: ENST00000426151
  CDS Start-End: 284-1708
agcttcacagctgggagagcgcaggaaggcgccgggaaggaaagccagcccaccagcgtctgggtgggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccaggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgag

SEQ ID NO: 112955 - DNA, 1523 bp, Homo sapiens
  Payload ID: 2101
  Gene Symbol: CALCR
  Gene Name: calcitonin receptor
  Uniprot ID: P30988
  ENST ID: ENST00000423724
  CDS Start-End: 1-873
atgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggccccagccttccacagagactaatctttcctttccctggccttctcatccggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttga

SEQ ID NO: 112956 - DNA, 3626 bp, Homo sapiens
  Payload ID: 2101
  Gene Symbol: CALCR
  Gene Name: calcitonin receptor
  ENST ID: ENST00000421592
  CDS Start-End: 290-1762
gggctgcgccgcgcggctggcggaccttcccgggttggagaagtgcgcacgtccgcacctcaccctgcggctgacatctcctgcccaggagatgggcgctgaagcttgagcgcctgagtccctggagccacacctgcgaacaccctttgcttctattgagctgtgcccagccgcccagtgacagaattccagaataaatgattcccactgatccacccacttttgccaccccaggatgcaattttctggagagaagattagtggacaaagagatcttcaaaaatcaaaaatgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcagaaaattgacaactatttttcctttgaattggaaatataggaaggcattgagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttgaatgtgaagcaaacacagcatcgtgatcactgagccatcatttcctgggagaaagaccatgcatttaaagtattctccatcctcccaggaaccgaacatatcatttgtgaagaattattcagtgaatttgtccattgtaaatctgaagaaagttattcttggtactgttgctttgggagacagtctaggaatggagtctcccactgcaacttgtgaactccatcattcatccaggactgagatgcaaatgtcacagtaatgcaagcaaagtatcaaagaaaaacaatgaaattgacctagttcagatacagggtgctccttgtcaatactgagccatttatacctttgaaatattaaaatcactgtcaatatttttatttttaactctggattttgaattagattatttctgtatttggctatggatctgatttttaatttttttaaatttcagtcaattctgatgttactgagatgttttaccatccttacaatgtaaaccacatgaactacgtgacctctgcaagacaaagcggctttctaatagagagattagtaaatatgtgaagaaaaagacctgcatttggcaggaagatgtatgctttgaatgcaaaagaaatttagagtcaatttgctgaaaacattacatgctcagcttggttttggacaagcctgtccattgggcaggacctagctgttgtaaagaattggtcttaatgttgaatgtattttggttgctgatgtttataaactgagaggtcacaaagaatctatcactaaaaatttttacaaaactgccaaaaatataattcttagtggaagacaatactccctttaaagagagtttgccactcccctaaactccaggatttataaagcaaattactccaaggtttataaagcagattacctcttgcccttgggtgctatctagcagtaaaagataaatttgttgaatattggtaattaaaagactccacataagtccattaactgctttccacccagcttcaaagcttaaaaagagctcaggcttttccaggaagatccaggagggctaattagaaatcaacttgtggttgaccgcttgtttcttgttattaccaaaacaggaggggaaaaaattaactgctccaaatttaaccataaatcaattcatgtttaacgtttctcattaaaatccagtattatattatcatatctctctttacttcccagtataagatttttgaaaatcctgaataaaccagtatcgttactggcacctgaaattaatttgtgaatttgcaacagtaatcagagttaccattatttaatttgtatgctaaatgaggaggtacattgaaaccctccaaatctccagtctcatctatgtcatattttgccactgcctttcagaagtgatttagttgtggaaagataataaattgatttgttatggttacatatttagcgcacccagagaaaattaattatatttctacagagaaaatgaatttgggatactaaagtagtttaagtctcctttactgaatgtaagggggggatcgaaaagaaggtatttttccaatcacagtgttatgtagtattgttctatttttgtttacaaacatggaaaacagagtatttctggcagctgtggtacaaatgtgataatatattgctaaaatattttagatgttattatgctaatatagtaggggttgaagaaaacaaaatagcttattatagaattgcacatagttctgcccaaattatgtgaaatgcttatgcttgtgtatatgtataaattaatacagagtacgttaaaagcaaaaagatgtatatttgcatatttttctaaagaaatatattattcatctttt

SEQ ID NO: 112957 - DNA, 1475 bp, Homo sapiens
  Payload ID: 2101
  Gene Symbol: CALCR
  Gene Name: calcitonin receptor
  Uniprot ID: P30988
  ENST ID: ENST00000415529
  CDS Start-End: 1-825
atgaggttcacatttacaagccggtgcttggcactgtttcttcttctaaatcacccaaccccaattcttcctgccttttcaaatcaaacctatccaacaatagagcccaagccatttctttacgtcgtaggacgaaagaagatgatggatgcacagtacaaatgctatgaccgaatgcagcagttacccgcataccaaggagaaggtccatattgcaatcgcacctgggatggatggctgtgctgggatgacacaccggctggagtattgtcctatcagttctgcccagattattttccggattttgatccatcagaaaaggttacaaaatactgtgatgaaaaaggtgtttggtttaaacatcctgaaaacaatcgaacctggtccaactatactatgtgcaatgctttcactcctgagaaactgaagaatgcatatgttctgtactatttggctattgtgggtcattctttgtcaattttcaccctagtgatttccctggggattttcgtgtttttcaggagccttggctgccaaagggtaaccctgcacaagaacatgtttcttacttacattctgaattctatgattatcatcatccacctggttgaagtagtacccaatggagagctcgtgcgaagggacccggtgagctgcaagattttgcattttttccaccagtacatgatggcctgcaactatttctggatgctctgtgaagggatctatcttcatacactcattgtcgtggctgtgtttactgagaagcaacgcttgcggtggtattatctcttgggctgggccccagccttccacagagactaatctttcctttccctggccttctcatccggttcccgctggtgccaaccactatccatgctattaccagggccgtgtacttcaatgacaactgctggctgagtgtggaaacccatttgctttacataatccatggacctgtcatggcggcacttgtggtcaatttcttctttttgctcaacattgtccgggtgcttgtgaccaaaatgagggaaacccatgaggcggaatcccacatgtacctgaaggctgtgaaggccaccatgatccttgtgcccctgctgggaatccagtttgtcgtctttccctggagaccttccaacaagatgcttgggaagatatatgattacgtgatgcactctctgattcatttccagggcttctttgttgcgaccatctactgcttctgcaacaatgaggtccaaaccaccgtgaagcgccaatgggcccaattcaaaattcagtggaaccagcgttgggggaggcgcccctccaaccgctctgctcgcgctgcagccgctgctgcggaggctggcgacatcccaatttacatctgccatcaggagctgaggaatgaaccagccaacaaccaaggcgaggagagtgctgagatcatccctttgaatatcatagagcaagagtcatctgcttga

SEQ ID NO: 112958 - DNA, 5155 bp, Homo sapiens
  Payload ID: 2102
  Gene Symbol: CALCRL
  Gene Name: calcitonin receptor-like
  Uniprot ID: Q16602
  ENST ID: ENST00000392370
  CDS Start-End: 715-2100
acacagcctatgatctctctctgttcaggctgcttcttgctcttgtctcacaataagaaaggagtgctgctttcctggggtatgctatttgagaaagaaagtaacctaacactaactgcaggcggggtcagagtgatgtaacaggaagctctgatgtttcccttctgctgctgatcacttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctatatttggtaaatattttaaagacaaccagatgccagcatcagaagtctgtttgagaactaagagaacagaaacatctatcataagatatatttattttaaaaacacaaggtcactattttattgaatatatttgttttgataactcataccttaataataggtgtgtttgacatatttcttttttcattttgacaatgaactcacattctaatccagaaattttaaacaactactgtgataaataccaatctgctacttttatagattttaccccattaaaatattactttactgacttttactatgtgaagatatatagctttggaaatgtcccaggctattcaagaaatataaaaaactagaaggatactatatataccatatacaatgctttaatattttaatagagctactgtatataatacaaattagggaaatacttgaatatatcattgagaaaaaattattgtcagatcttactgaattattgtcagactttattaaataaagatagaagaaaaccttgctaatgaattaaagtgaaatttgcatgggattcagtttctctaatgttattttccgctgaaatctctaaagaacaagaatgacttcaattagtaaaagtcaattttgggaaaagtcatgggtatctgttttttaagtgtgtcaatctgattaaaatggatgaaacaaattactcatcataagttgtttcttaagctgtcaatatgtcaatagatggtgagttcagaacttatttcaaattgctaagacaaattatctaaattcgtaagaattaacatatagaatggtctggtcagtacatttataatttatctatgcatgaaaaagtattgttttgtttgaaacatgaatttcatagcaagctgccatagaaaggaacgcaggctgttctagaccttcaactgcctaaattatacaaaaattcattttaataaactcaattattagctatttattattcaaagacccatatttaaatcctttgctgaccatgttgacatatatcagccttcttctagacaaactgtcaactctcaaccatcttgacagtagaagtgacagtaaaaaatgttgaatgatcagagattatattaaaataaacatgtaattttcaagtatttttgttgtgcttttataatattaattctagatcagatttattttatagccagggtttgtctgttgtagagtcttgaggcgtagcagtcattcatgattaatcactgttagttttgtacccatatatttttagaatagttttaaatgttagatttctcaaaagctaaatgctacttaatatctttgtatcatactcataaagcaaagtaaatctgacactttttttaaagcaaacttctttgctgtcaaaaaaataaatttggggaaatttctagcttttaaaatgtagatctgcattttactgtgattacttgtgaaagtcatattttaattttctaaattctaatttgtcattttatttcctaaagttaatttccaatgcatttattcataaaatattcattctggaatgcagtgtttgtttaaatgtaatccaatgtatatagaattagtggtggctgtagtgctgtatttattgcttataattttttttaaatgtgaacttacttttaattttctcttggttttaatctgctagtagaaaccactagttatctgtaaaaatatattcaagatattctgatcaattataacaatttatgttatgcctagagtatatctctattttttgattgtatgaaaatattaaagttatgagttaaagtttattttcactgatatttactacagtgccaaataatctaatttataaacataattcttacagtaatcaatgggatacttctcaaaattaacaaatctcttaacaaaatatatcttttgccctctttaaagtcttcagtaaaccagtaaatgaattcaataaaccaa

SEQ ID NO: 112959 - DNA, 591 bp, Homo sapiens
  Payload ID: 2102
  Gene Symbol: CALCRL
  Gene Name: calcitonin receptor-like
  ENST ID: ENST00000410102
  CDS Start-End: 479-591
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcatcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactag

SEQ ID NO: 112960 - DNA, 5223 bp, Homo sapiens
  Payload ID: 2102
  Gene Symbol: CALCRL
  Gene Name: calcitonin receptor-like
  Uniprot ID: Q16602
  ENST ID: ENST00000409998
  CDS Start-End: 783-2168
acacagcctatgatctctctctgttcaggctgcttcttgctcttgtctcacaataagaaaggagtgctgctttcctggggtatgctatttgagaaagaaagtaacctaacactaactgcaggcggggtcagagtgatgtaacaggaagctctgatgtttcccttctgctgctgatcacttacaatctgacaacacttacaatctactcagaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcatatcgtctaataataaaaacccatactagcctatagaaaacaatatttgaaagattgctaccactaaaaagaaaactactacaacttgacaagactgctgcaaacttcaatttgtcaaccacaacttgacaaggttgctataaaacaagattgctacaacttctagtttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcaccaagtgtggaattggagaaaagcacaatcaacttttctgagctggtgtaagccagttccagcacaccattgcatgaattcacaaacaaatggctgtaaaactaaacatacatgttgggcatgattctacccttattgccccaagagacctagctaaggtctataaacatgaagggaaaattagcttttagttttaaaactctttatcccatcttgattggggcagttgactttttttttgcccagagtgccgtagtcctttttgtaactaccctctcaaatggacaataccagaagtgaattatccctgctggctttcttttctctatgaaaagcaactgagtacaattgttatgatctactcatttgctgacacatcagttatatcttgtggcatatccattgtggaaactggatgaacaggatgtataatatgcaatcctacttctatatcattaggaaaacatcttagttgatgctacaaaacaccttgtcaacctcttcctgtcttaccaaacagtgggagggaattcctagctgtaaatataaattttgtcccttccatttctactgtataaacaaattagcaatcattttatataaagaaaatcaatgaaggatttcttattttcttggaattttgtaaaaagaaattgtgaaaaatgagcttgtaaatactccattattttattttatagtctcaaatcaaatacatacaacctatgtaatttttaaagcaaatatataatgcaacaatgtgtgtatgttaatatctgatactgtatctgggctgattttttaaataaaatagagtctggaatgctatatttggtaaatattttaaagacaaccagatgccagcatcagaagtctgtttgagaactaagagaacagaaacatctatcataagatatatttattttaaaaacacaaggtcactattttattgaatatatttgttttgataactcataccttaataataggtgtgtttgacatatttcttttttcattttgacaatgaactcacattctaatccagaaattttaaacaactactgtgataaataccaatctgctacttttatagattttaccccattaaaatattactttactgacttttactatgtgaagatatatagctttggaaatgtcccaggctattcaagaaatataaaaaactagaaggatactatatataccatatacaatgctttaatattttaatagagctactgtatataatacaaattagggaaatacttgaatatatcattgagaaaaaattattgtcagatcttactgaattattgtcagactttattaaataaagatagaagaaaaccttgctaatgaattaaagtgaaatttgcatgggattcagtttctctaatgttattttccgctgaaatctctaaagaacaagaatgacttcaattagtaaaagtcaattttgggaaaagtcatgggtatctgttttttaagtgtgtcaatctgattaaaatggatgaaacaaattactcatcataagttgtttcttaagctgtcaatatgtcaatagatggtgagttcagaacttatttcaaattgctaagacaaattatctaaattcgtaagaattaacatatagaatggtctggtcagtacatttataatttatctatgcatgaaaaagtattgttttgtttgaaacatgaatttcatagcaagctgccatagaaaggaacgcaggctgttctagaccttcaactgcctaaattatacaaaaattcattttaataaactcaattattagctatttattattcaaagacccatatttaaatcctttgctgaccatgttgacatatatcagccttcttctagacaaactgtcaactctcaaccatcttgacagtagaagtgacagtaaaaaatgttgaatgatcagagattatattaaaataaacatgtaattttcaagtatttttgttgtgcttttataatattaattctagatcagatttattttatagccagggtttgtctgttgtagagtcttgaggcgtagcagtcattcatgattaatcactgttagttttgtacccatatatttttagaatagttttaaatgttagatttctcaaaagctaaatgctacttaatatctttgtatcatactcataaagcaaagtaaatctgacactttttttaaagcaaacttctttgctgtcaaaaaaataaatttggggaaatttctagcttttaaaatgtagatctgcattttactgtgattacttgtgaaagtcatattttaattttctaaattctaatttgtcattttatttcctaaagttaatttccaatgcatttattcataaaatattcattctggaatgcagtgtttgtttaaatgtaatccaatgtatatagaattagtggtggctgtagtgctgtatttattgcttataattttttttaaatgtgaacttacttttaattttctcttggttttaatctgctagtagaaaccactagttatctgtaaaaatatattcaagatattctgatcaattataacaatttatgttatgcctagagtatatctctattttttgattgtatgaaaatattaaagttatgagttaaagtttattttcactgatatttactacagtgccaaataatctaatttataaacataattcttacagtaatcaatgggatacttctcaaaattaacaaatctcttaacaaaatatatcttttgccctctttaaagtcttcagtaaaccagtaaatgaattcaataaaccaa

SEQ ID NO: 112961 - DNA, 1984 bp, Homo sapiens
  Payload ID: 2102
  Gene Symbol: CALCRL
  Gene Name: calcitonin receptor-like
  Uniprot ID: Q16602
  ENST ID: ENST00000410068
  CDS Start-End: 342-1727
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactgggtcttgacccctgaatttaagaaattcttaaagacaatgtcaaatatgatccaagagaaaatgtgatttgagactggagacaattgtgcattttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgttgcagcaggaactgaatcaatgcagctctgccctgattactttcaggactttgatccatcagaaaaagttacaaagatctgtgaccaagatggaaactggtttagacatccagcaagcaacagaacatggacaaattatacccagtgtaatgttaacacccacgagaaagtgaagactgcactaaatttgttttacctgaccataattggacacggattgtctattgcatcactgcttatctcgcttggcatattcttttatttcaagagcctaagttgccaaaggattaccttacacaaaaatctgttcttctcatttgtttgtaactctgttgtaacaatcattcacctcactgcagtggccaacaaccaggccttagtagccacaaatcctgttagttgcaaagtgtcccagttcattcatctttacctgatgggctgtaattacttttggatgctctgtgaaggcatttacctacacacactcattgtggtggccgtgtttgcagagaagcaacatttaatgtggtattattttcttggctggggatttccactgattcctgcttgtatacatgccattgctagaagcttatattacaatgacaattgctggatcagttctgatacccatctcctctacattatccatggcccaatttgtgctgctttactggtgaatctttttttcttgttaaatattgtacgcgttctcatcaccaagttaaaagttacacaccaagcggaatccaatctgtacatgaaagctgtgagagctactcttatcttggtgccattgcttggcattgaatttgtgctgattccatggcgacctgaaggaaagattgcagaggaggtatatgactacatcatgcacatccttatgcacttccagggtcttttggtctctaccattttctgcttctttaatggagaggttcaagcaattctgagaagaaactggaatcaatacaaaatccaatttggaaacagcttttccaactcagaagctcttcgtagtgcgtcttacacagtgtcaacaatcagtgatggtccaggttatagtcatgactgtcctagtgaacacttaaatggaaaaagcatccatgatattgaaaatgttctcttaaaaccagaaaatttatataattgaaaatagaaggatggttgtctcactgttttgtgcttctcctaactcaaggacttggacccatgactctgtagccagaagacttcaatattaaatgactttttgaatgtcataaagaagagccttcacatgaaattagtagtgtgttgataagagtgtaacatccagctctatgtgggaaaaaagaaatcctggtttgtaatgtttgtcagtaaatactcccactatgcctgatgtgacgctactaacctgacatcacc

SEQ ID NO: 112962 - DNA, 642 bp, Homo sapiens
  Payload ID: 2102
  Gene Symbol: CALCRL
  Gene Name: calcitonin receptor-like
  ENST ID: ENST00000447403
  CDS Start-End: 410-642
agaacaacctctctctctccagcagagagtgtcacctcctgctttaggaccatcaagctctgctaactgaatctcatcctaattgcaggatcacattgcaaagctttcactctttcccaccttgcttgtgggtaaatctcttctgcggaatctcagaaagtaaagttccatcctgagaatatttcacaaagaatttccttaagagctggactggggtcctacgatgatacaccaaccacttgtgctaccatctgtcaaaactttggatggccctactttcaggtcttgacccctgaatttaagaaattcttaaagacaatgtcaaatatgatccaagagaaaatgtgatttgagactggagacaattgtgcattttatgttatacagcatatttcattttggcttaatgatggagaaaaagtgtaccctgtattttctggttctcttgcctttttttatgattcttgttacagcagaattagaagagagtcctgaggactcaattcagttgggagttactagaaataaaatcatgacagctcaatatgaatgttaccaaaagattatgcaagaccccattcaacaagcagaaggcgtttactgcaacagaacctgggatggatggctctgctggaacgatgt

SEQ ID NO: 112963 - DNA, 843 bp, Homo sapiens
  Payload ID: 2103
  Gene Symbol: CALCA
  Gene Name: calcitonin-related polypeptide alpha
  Uniprot ID: P01258
  ENST ID: ENST00000331587
  CDS Start-End: 120-545
ggcatcagagacactgcccagcccaagtgtcgccgccgcttccacagggctctggctggacgccgccgccgccgctgccaccgcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctggtattggtggctttccttgtggcagaggatgtctcaaacttcagatgggaggaaagagagcaggactcacaggttggaagagaatcacctgggaaaataccagaaaatgagggccgctttgagtcccccagagatgtcatcagagctcctctgtcctgcttctgaatgtgctgatcatttgaggaataaaattatttttccccaaa

SEQ ID NO: 112964 - DNA, 916 bp, Homo sapiens
  Payload ID: 2103
  Gene Symbol: CALCA
  Gene Name: calcitonin-related polypeptide alpha
  Uniprot ID: P06881
  ENST ID: ENST00000361010
  CDS Start-End: 76-462
ccgccgctgccaccgcctctgatccaagccacctcccgccaggtgagccccgagatcctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttca

SEQ ID NO: 112965 - DNA, 581 bp, Homo sapiens
  Payload ID: 2103
  Gene Symbol: CALCA
  Gene Name: calcitonin-related polypeptide alpha
  Uniprot ID: P01258
  ENST ID: ENST00000396372
  CDS Start-End: 63-488
cgcctctgatccaagccacctcccgccaggtgagccccgagatcctggctcagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcatgttagcatgccccagaatgccaactaaactcctccctttccttcctaatttcccttcttgcatccttcctataacttgatgcatgtggtttggttcctctctggtggctctttgggctgg

SEQ ID NO: 112966 - DNA, 851 bp, Homo sapiens
  Payload ID: 2103
  Gene Symbol: CALCA
  Gene Name: calcitonin-related polypeptide alpha
  Uniprot ID: P06881
  ENST ID: ENST00000486207
  CDS Start-End: 10-396
agaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagaatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccatggaagacatacatataggcatccttcttgatactgaaaactatcttctttgtttgaaaggaactattgctaaatgcagaacaagctcattgcagttacctattgtgcatctttttaaatacttgattatgtaaccataaatctgacagcatgtctcattggcttatctggtagcaaatctaggccccgtcagccaccctattgacattggtggctctgctaaacctcagggggacatgaaatcactgcctcttgggcatctggggacacatggtaatgctgtgccttgacagaagtatttgtttaaagaaatgtcaatgctgtcatttgtgaactctatcaaaattaaaaatgtattttctatacccttcaa

SEQ ID NO: 112967 - DNA, 679 bp, Homo sapiens
  Payload ID: 2103
  Gene Symbol: CALCA
  Gene Name: calcitonin-related polypeptide alpha
  Uniprot ID: P01258
  ENST ID: ENST00000469608
  CDS Start-End: 38-463
gcctctgatccaagccacctcccgccagagaggtgtcatgggcttccaaaagttctcccccttcctggctctcagcatcttggtcctgttgcaggcaggcagcctccatgcagcaccattcaggtctgccctggagagcagcccagcagacccggccacgctcagtgaggacgaagcgcgcctcctgctggctgcactggtgcaggactatgtgcagatgaaggccagtgagctggagcaggagcaagagagagagggctccagcctggacagccccagatctaagcggtgcggtaatctgagtacttgcatgctgggcacatacacgcaggacttcaacaagtttcacacgttcccccaaactgcaattggggttggagcacctggaaagaaaagggatatgtccagcgacttggagagagaccatcgccctcataatcattgcccagaagagagcctgtgacactgccacctgtgtgactcatcggctggcaggcttgctgagcagatcagggggtgtggtgaagaacaactttgtgcccaccaatgtgggttccaaagcctttggcaggcgccgcagggaccttcaagcctgagcagctgaatgactcaagaaggtcacaataaagctgaactccttttaatgtgtaatgaaagcaatttgtaggaaaggctccat

SEQ ID NO: 112968 - DNA, 1070 bp, Homo sapiens
  Payload ID: 2104
  Gene Symbol: CALCB
  Gene Name: calcitonin-related polypeptide beta
  Uniprot ID: P10092
  ENST ID: ENST00000324229
  CDS Start-End: 112-495
gtaataagagcggggtctccgcggggaaggcgcccacagcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgct

SEQ ID NO: 112969 - DNA, 2258 bp, Homo sapiens
  Payload ID: 2104
  Gene Symbol: CALCB
  Gene Name: calcitonin-related polypeptide beta
  ENST ID: ENST00000523376
  CDS Start-End: 1263-1679
gtcggccgcgaaggcgtggcggcccgcggaccggcggaccccgggtcataccagctgtccgggtgcacaggcccaggggccccacgaccgcgggtgtcgggaccgtgggctccactgaggagcccaccgaatccttcggcctggccaggcggggggtcttcttcccagtccgcggaagccaggtccgggagacggcggggctcactgtgccttcggacctacactctgctcgggggccggatttctgcaaagcgtccacttggaaagaagtttcacttgcagggaaggcgggtgtacgcaatgatggtccgtgtgtccgggatgtgaatgccaaccaagactgcgtccgttggtggagtgtgcgcgggtcctccgtgagggtgcttctggcagtcacagttcacgagttagcgagaagatggctgggaggcggcgagcccccgctcccggggcgcgcatttcgaactccataggtctcccgtggagagcagcccagacccggccacactcagtgaggaggaagtgcgcctcctgctggctgcactggtgcaggactatgtgcagatgaaggccagtgagctggagcaggagcaggagacagagctccagatttaatttatgtccttttcttctatcttctttggatggaggctgagtttcagttcttgccggagagtttccagatttctcctcctgatggcctgttctgtggattttggatttgccaaggcagccctcacaatccgagtcctggggctgtctaaggaactatggtgagatagagtgttatgggttgaattttgtccccctcaaaaaggtaccattgtcttctaaaagaacaactgaggagttcaacatgaaggaggaaggatatgtcattctttgcagtgacacaatcagaaaaggtactgctcccccacctaaatatgagggataagtgattttcagaagagacaggagaagaagggacaaatgtcctggtccttgtctccttgtcaacaaaagatgtactggtaccctttgaaaggggacagagaggatgccagctgaactgggagcactaagttctctgctttgtgaaaatgaatctgcaatgaactcctggtctttgtctggatgcccatctttctgcaagttgtcagcagaagcttttcaatgtggctacttggtgagttcacatacagcccaacccatagttctgatggagcctgaaaatcagccctgaaaagttctcctcagaggatgcctctgaagtgagaggcatgaaaaaagaggctaaccttcagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggttatcatgaaactgaactcaccatttctattaatttctgttggtaagaacttggtgagaatgccccgtggaagatacacatgtttgcatcctaagatactgaaaaaagggcacctttgtcacttgaaaggaatgaaactgaatgcaaaataagctaattccatatttgctgtgcatcatttttatatttaattctatgtccagtaaaagtgatggcatctctcattgacttatctggtagcaaactggttctttcggagccatcctgttgatcatgcagctccaccaaaccttagggggacgtgaaatcactgcctgttgtggtctccgaggacacatggtaatggtgatgctgtgccttgttatctaagaacatgattgtataatttgtttaagaaaatgtcaatattgtgccatttgtgaacttcatcaagattaaaagcatattttgggtacatttgtttcaaaaccttggtgatgcattacaacttgttttcttatgtaataataatgatgatgatgatgataataataaatatttttgagtgcttact

SEQ ID NO: 112970 - DNA, 2097 bp, Homo sapiens
  Payload ID: 2104
  Gene Symbol: CALCB
  Gene Name: calcitonin-related polypeptide beta
  Uniprot ID: P10092
  ENST ID: ENST00000533448
  CDS Start-End: 112-495
gtaataagagcggggtctccgcggggaaggcgcccacagcaggtgtggtgttcatcccgggtcgaccggccgctcgcgctgccctgaaactctagtcgccagagaggcggcatgggtttccggaagttctcccccttcctggctctcagtatcttggtcctgtaccaggcgggcagcctccaggcggcgccattcaggtctgccctggagagcagcccagacccggccacactcagtaaagaggacgcgcgcctcctgctggctgcactggtgcaggactatgtgcagatgaaggccagtgagctgaagcaggagcaggagacacagggctccagctccgctgcccagaagagagcctgcaacactgccacctgtgtgactcatcggctggcaggcttgctgagcagatcagggggcatggtgaagagcaacttcgtgcccaccaatgtgggttccaaagcctttggcaggcgccgcagggaccttcaagcctgagcagatgaatgactccaggaagaaggtgtgtcctaaatccaatgacatatccttataagagattcactcagaagacacatgtggagaaggtgacatgacagaggcaaggaggcacaagccaaggaagtctgtgtctaccagaagccagaatcacagaacagtctctggaagaagagcagccctgctgacacctagagtttggacttccagcttccagaactgtgagagaataatttctgttgttttaagccacaaagtttgtggtaatttgttatgacagccctaggaaactaatacaatacattttcatttattttgggtaaatgccttggagtgggattgctgggttatttggaaagtgtgtatttaactctgtaagaaactgccaaactattttctgaagtgactgtaccacttcgccttcttgccagccacatatgagagctctagtatttccacaaataggtatgtagcagtatctcattgctgttttaatttgtatttccccaatgactaatgacgttgagcatctattttaccatatgtttatcacctttattgaagggtctgtttaaatcttctgctaaatttttgttggcttgcttgctttattagtgttgagtttttagagctctttatatgttgtggatgcaagattgttttcagatatatagtttggaaacttccttcccctgaatctgcggattgctttttcattttcttagcagtgtctctcacagagaaaaagttgtaatttgaataagatccaattcatctttttttttcttttatgtattgtgcttttagttcatgtctaagaactctttgcctaactaaggtcccaaggtcacaataaccttattctatactttcttgtaaaagttttatagttttatattttatatgtagattagtgatctattttgagttaatttttgtataaggtgagaggtgtaggttgaaattcatacctgtgaatatagatacccaattgtttcagtgccatttgttaaaaagactgttatttcaccatttaattgcccctgcacctttgtcaaaaagcaactgatcatatttgtgtgggtatatttctgggttctcaattctgtctcattgattgatttgaccattcttttgccaatgtcatactgccttgattagtgtagtgttaaagtgaatctcaaaaccaggtaatgtgggtctaccaacattgttcattcttgttcaaaaagattttagctacatctaaaatattttctacatcttttatacattttagaatcagtgtgttactatctacaaaatttctgatgagatttttaatgggattgtgttaaatcagtgggttaattttgggagaattagcatattaataatattaagtcgttcaattcatgaacacaatacatgttttcacttatttaggttttctctgtttttttttttttaacagtgttctcagttttcaacagaaatattctacacatatcttgttagatttttaactattttattttttggtgctaatgtaaatggtacttaaacatttttgtttttaattgttcattgctagtagatagaaatacaatatttaaaatatta

SEQ ID NO: 112971 - DNA, 3534 bp, Homo sapiens
  Payload ID: 2105
  Gene Symbol: CANT1
  Gene Name: calcium activated nucleotidase 1
  Uniprot ID: Q8WVQ1
  ENST ID: ENST00000302345
  CDS Start-End: 496-1701
agaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgt

SEQ ID NO: 112972 - DNA, 3252 bp, Homo sapiens
  Payload ID: 2105
  Gene Symbol: CANT1
  Gene Name: calcium activated nucleotidase 1
  Uniprot ID: Q8WVQ1
  ENST ID: ENST00000392446
  CDS Start-End: 214-1419
cagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgt

SEQ ID NO: 112973 - DNA, 466 bp, Homo sapiens
  Payload ID: 2105
  Gene Symbol: CANT1
  Gene Name: calcium activated nucleotidase 1
  ENST ID: ENST00000591811
  CDS Start-End: 351-466
aaaccacagctcccagcagccctcgcgccgtccgcgcgcagccgcagagcagaggctgccgggaacgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgctt

SEQ ID NO: 112974 - DNA, 881 bp, Homo sapiens
  Payload ID: 2105
  Gene Symbol: CANT1
  Gene Name: calcium activated nucleotidase 1
  ENST ID: ENST00000588075
  CDS Start-End: 652-881
cgcgggcccagaggcggggcgagcgcgcgcggggcggaagtcggccaccttcctccgtcccggccgttagcccagccaagcccagccaagcccagccaagccccgccgatcgcgggcaccggagccagccccgcagcggaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcagagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactg

SEQ ID NO: 112975 - DNA, 900 bp, Homo sapiens
  Payload ID: 2105
  Gene Symbol: CANT1
  Gene Name: calcium activated nucleotidase 1
  ENST ID: ENST00000588611
  CDS Start-End: 545-900
gcgcgcgcggggcggaagtcggccaccttcctccgtcccggccgttagcccagccaagcccagccaagcccagccaagccccgccgatcgcgggcaccggagccagccccgcagcgggaagctggagaaacaaaccctcttggctgtctgctgtccagggagtcgccactcccttcattatagccttgctcagagtgcagcggcaggcctggggatggcctcgggagaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttt

SEQ ID NO: 112976 - DNA, 614 bp, Homo sapiens
  Payload ID: 2105
  Gene Symbol: CANT1
  Gene Name: calcium activated nucleotidase 1
  ENST ID: ENST00000590370
  CDS Start-End: 419-614
agtcggccaccttcctccgtcccggccgttagcccagccaagcccagccaagcccagccaagccccgccgatcgcgggcaccggagccagccccgcagcggaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggccc

SEQ ID NO: 112977 - DNA, 1546 bp, Homo sapiens
  Payload ID: 2105
  Gene Symbol: CANT1
  Gene Name: calcium activated nucleotidase 1
  ENST ID: ENST00000592228
  CDS Start-End: 127-921
ggaagtcggccaccttcctccgtcccggccgttagcccagccaagcccagccaagcccagccaagccccgccgatcgcgggcaccggagccagccccgcagcgggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggtaactggaccctgagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggag

SEQ ID NO: 112978 - DNA, 1669 bp, Homo sapiens
  Payload ID: 2105
  Gene Symbol: CANT1
  Gene Name: calcium activated nucleotidase 1
  Uniprot ID: Q8WVQ1
  ENST ID: ENST00000591773
  CDS Start-End: 401-1606
gcgcgcggggcggaagtcggccaccttcctccgtcccggccgttagcccagccaagcccagccaagcccagccaagccccgccgatcgcgggcaccggagccagccccgcagcgggagcctaacccagaggaagtggagactcctttactgcacatctgtctgctccaggccaggcactgttctaggagccaggatacagaggtggagacagaaacaaacaaaccgataactgtatacaatactctaacgtcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgc

SEQ ID NO: 112979 - DNA, 599 bp, Homo sapiens
  Payload ID: 2105
  Gene Symbol: CANT1
  Gene Name: calcium activated nucleotidase 1
  ENST ID: ENST00000591625
  CDS Start-End: 554-599
aagtcggccaccttcctccgtcccggccgttagcccagccaagcccagccaagcccagccaagccccgccgatcgcgggcaccggagccagccccgcagcgggaagctggagaaacaaaccctcttggctgtctgctgtccagggagtcgccactcccttcattatagccttgctcagagtgcagcggcaggcctggggatggcctcgggagagggaccacagagcaccagcctgcatggaacttccttcctcactcagcttcccacgttgccagctgggacaggggagatggagtaattttgctgtggaaagacttcacgtcttgccgaatgaaagtaagcaaagatactgctagagtcgggaatctagagtcgggaattcattaagccaagggagtaagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgc

SEQ ID NO: 112980 - DNA, 502 bp, Homo sapiens
  Payload ID: 2105
  Gene Symbol: CANT1
  Gene Name: calcium activated nucleotidase 1
  ENST ID: ENST00000592033
  CDS Start-End: 387-502
agaggcggggcgagcgcgcgcggggcggaagtcggccaccttcctccgtcccggccgttagcccagccaagcccagccaagcccagccaagccccgccgatcgcgggcaccggagccagccccgcagcgggaagctggagaaacaaaccctcttggctgtctgctgtccagggagtcgccactcccttcattatagccttgctcagagtgcagcggcaggcctggggatggcctcgggagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgctt

SEQ ID NO: 112981 - DNA, 769 bp, Homo sapiens
  Payload ID: 2105
  Gene Symbol: CANT1
  Gene Name: calcium activated nucleotidase 1
  ENST ID: ENST00000586916
  CDS Start-End: 587-769
agaggcggggcgagcgcgcgcggggcggaagtcggccaccttcctccgtcccggccgttagcccagccaagcccagccaagcccagccaagccccgccgatcgcgggcaccggagccagccccgcagcggaaaagcacatctcccaggatcctgagagagcttgaaccagaccactgtggacacggtggccacccgtcaccactacccttcccaaggggagacgaggagcaagtaggcttgagggaaaagctgcacaggactcgtgtcttgaaatgtctaagacgcatgtcagaaatgcaggagcctaacccagaggaagtggagactcctttactgcacatctgtctgctccaggccaggcactgttctaggagccaggatacagaggtggagacagaaacaaacaaaccgataactgtatacaatactctaacgtcagagggaccacagagcaccagcctgcatggaacttccttcctcactcagcttcccacgttgccagctgggacaggggagatggagtaattttgctgtggaaagacttcacgtcttgccgaatgaaagtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcc

SEQ ID NO: 112982 - DNA, 3337 bp, Homo sapiens
  Payload ID: 2105
  Gene Symbol: CANT1
  Gene Name: calcium activated nucleotidase 1
  Uniprot ID: Q8WVQ1
  ENST ID: ENST00000620915
  CDS Start-End: 299-1504
gctgcaggagcctaacccagaggaagtggagactcctttactgcacatctgtctgctccaggccaggcactgttctaggagccaggatacagaggtggagacagaaacaaacaaaccgataactgtatacaatactctaacgtcagaatggccacagagtagtgaaatactgtttcttctggaaaagtcagcctccagcgcctgcagcttccggaactaagatgtgactgggcttgcggaggcgctgactcctctcctccctccctggctgtgcaggtcccgcctgtctgtcacgctgatgcccgtgcagctgtctgagcacccggaatggaatgagtctatgcactccctccggatcagtgtggggggccttcctgtgctggcgtccatgaccaaggccgcggacccccgcttccgcccccgctggaaggtgatcctgacgttctttgtgggtgctgccatcctctggctgctctgctcccaccgcccggcccccggcaggccccccacccacaatgcacacaactggaggctcggccaggcgcccgccaactggtacaatgacacctaccccctgtctcccccacaaaggacaccggctgggattcggtatcgaatcgcagttatcgcagacctggacacagagtcaagggcccaagaggaaaacacctggttcagttacctgaaaaagggctacctgaccctgtcagacagtggggacaaggtggccgtggaatgggacaaagaccatggggtcctggagtcccacctggcggagaaggggagaggcatggagctatccgacctgattgttttcaatgggaaactctactccgtggatgaccggacgggggtcgtctaccagatcgaaggcagcaaagccgtgccctgggtgattctgtccgacggcgacggcaccgtggagaaaggcttcaaggccgaatggctggcagtgaaggacgagcgtctgtacgtgggcggcctgggcaaggagtggacgaccactacgggtgatgtggtgaacgagaacccggagtgggtgaaggtggtgggctacaagggcagcgtggaccacgagaactgggtgtccaactacaacgccctgcgggctgctgccggcatccagccgccaggctacctcatccatgagtctgcctgctggagtgacacgctgcagcgctggttcttcctgccgcgccgcgccagccaggagcgctacagcgagaaggacgacgagcgcaagggcgccaacctgctgctgagcgcctcccctgacttcggcgacatcgctgtgagccacgtcggggcggtggtccccactcacggcttctcgtccttcaagttcatccccaacaccgacgaccagatcattgtggccctcaaatccgaggaggacagcggcagagtcgcctcctacatcatggccttcacgctggacgggcgcttcctgttgccggagaccaagatcggaagcgtgaaatacgaaggcatcgagttcatttaactcaaaacggaaacactgagcaaggccatcaggactcagcttttataaaaacaagaggagtgcacttttgttttgttttgttctttttggaactgtgcctgggttggaggtctggacagggagcccagtcccgggccccatagtggtgcgggcactggacccccgggccccacggaggccgcggtctgaactgctttccatgctgccatctggtggtgatttcggtcacttcaggcattgactcaaggcctgcctaactggctgggtcgtttcttccatccgacctcgtttcttttctttcctatgttcttttgttcagtgaatatccctagagctcctaccatatgtcaggccctatgcctcaccctgagaacgcagtgagcatgaggtggacctgtttgctgggaaccccaggtcacccccttttcttcctactctgtgcctggagcatcatgtccacccctgcagatccttggaaaagaaaatgtttatgttgcagggtattgcatggtcacgagtgagggcaggcccctggggacacatctgcccacagctgcacaggccagggcgcaggcacatctgttggttctcaggcctcagataaaaccatctccgcatcatatggccagtgaccgctttctcccttcaagaaaattctgtggctgtgcagtactttgaagttttaattattaacctgctttaattaaagcagtttcctttcttataaagtggaatcaccaaatcttatcacacagagcacagtcctgtagttacccagcccgctccagcagtgcgggagattgtaaggaagcggtggcggctggtgaagcaagtctcacatgtcggcgttcttggccaatggatacaaagataaagaaaatgttgcctttttctaggaactgtcagaaatcctcatgcctttcaagacttctgtgaatgacttgaattttttattccctgcctagggtctgtgaacgaggcctgtctcttccctggggtttctttccatggcctttatttctcctcttccagtgggagttttgcaggctcttctctgtggaaacttcacgagcgttggctgggcctcggcttcgctggagtgtactccagggtgaaggcagagtgggatttgagacccaggttaggcacgacccaggctgagaagggacgtttccatcattcacagtgccctccccacagcactacctcaccccgacccccaccctcactcctaccccaccccgcgatcgtcaggggtgccacggtgggccggagggtgccggctctggctgtccctgtgccggtccctcacaaacctctccccctttgaaactcaagcacagctgcgaggagggcagcgaggagggacccctctctcatggttgtctctttcccccgctatgtcataggtagtggaggaagcgaaggaagtgaacgctgaatgtgacgcatttctgaagagctcagctgtcaccgggcatagcctggaagccccaagtctgttctgactttgcctggctgtctccttgacccgcctcctagatcattgtccttgatgtccaggctgggtcatttaaaatagagatgcaatcaggaaggttgggggacttgggactgtggctgaattgagaccttgctgatgtattcatgtcagcacctgagtcacagcccaggtgcccggaagcagcctcttcgcataggcagtgatttgcgattactttaaagctcaccttttttcttcccctctctgttcgctgctgtcagcataatgattgtgttccttccctatgggatccatctgttttgtaaacaataaagcgtctgagggagtgt

SEQ ID NO: 112983 - DNA, 1247 bp, Homo sapiens
  Payload ID: 2106
  Gene Symbol: CIB1
  Gene Name: calcium and integrin binding 1 (calmyrin)
  Uniprot ID: Q99828
  ENST ID: ENST00000328649
  CDS Start-End: 163-738
ggctgggaacgcctggcagcttttaggagggggcgggcccgggggtggtggccccaggagcggttgccgcggggaccgggcagtgacgcggcccaagggcggaagtgagaaagttgtctgcgtctcgaggcgagttggcggagctgtgcgcgcggcggggcgatggggggctcgggcagtcgcctgtccaaggagctgctggccgagtaccaggacttgacgttcctgacgaagcaggagatcctcctagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgaccctatgtgtgacatgagatacactggtatgaggaaggactggacttctcttctaagagccttcaatcatcctaggaataagcagcatatcgagcagaggccagcgggaagtcaagccgcacccacgctggctgtccccgtgggagggtgtgaggatgaaggggcagcaggaggtgtgggactcgcctgtatcctgattggggtggtggttagatgagtctctgcatgcatcaaaatgtaaagaaccgtacatcagtaaagtctattttactgca

SEQ ID NO: 112984 - DNA, 1096 bp, Homo sapiens
  Payload ID: 2106
  Gene Symbol: CIB1
  Gene Name: calcium and integrin binding 1 (calmyrin)
  Uniprot ID: Q99828
  ENST ID: ENST00000612800
  CDS Start-End: 163-858
ggctgggaacgcctggcagcttttaggagggggcgggcccgggggtggtggccccaggagcggttgccgcggggaccgggcagtgacgcggcccaagggcggaagtgagaaagttgtctgcgtctcgaggcgagttggcggagctgtgcgcgcggcggggcgatggggggctcgggcagtcgcctgtccaaggagctgctggccgagtaccaggacttgacgttcctgacgaagcaggagatcctcctttctgtgtacgtggttttagctcctcacctggttgacaatgagcagcaggcaaggagtgggaatgaacacacagggagaccgatcgctgagaacaccgacagttcccctctctctaccagagcccacaggcggttttgtgagctgcttccccaggagcagcggagcgtggagtcgtcacttcgggcacaagtgcccttcgagcagattctcagccttccagagctcaaggccaaccccttcaaggagcgaatctgcagggtcttctccacatccccagccaaagacagccttagctttgaggacttcctggatctcctcagtgtgttcagtgacacagccacgccagacatcaagtcccattatgccttccgcatctttgactttgatgatgacggaaccttgaacagagaagacctgagccggctggtgaactgcctcacgggagagggcgaggacacacggcttagtgcgtctgagatgaagcagctcatcgacaacatcctggaggagtctgacattgacagggatggaaccatcaacctctctgagttccagcacgtcatctcccgttctccagactttgccagctcctttaagattgtcctgtgacagcagccccagcgtgtgtcctggcaccctgtccaagaacctttctactgctgagctgtggccaaggtcaagcctgtgttgccagtgcgggccaagctggcccagcctggagctggcgctgtgcagcctcaccccgggcaggggcggccctcgttgtcagggcctctcctcactgctgttgtcattgctccgtttgtgtttgtactaatcagtaataaaggtttagaagtttgaccct

SEQ ID NO: 112985 - DNA, 1598 bp, Homo sapiens
  Payload ID: 2107
  Gene Symbol: CIB2
  Gene Name: calcium and integrin binding family member 2
  Uniprot ID: O75838
  ENST ID: ENST00000258930
  CDS Start-End: 330-893
gcgggagccaagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccctttgctctccatgtatgctaatgttaggaaatgtttgagggta

SEQ ID NO: 112986 - DNA, 1511 bp, Homo sapiens
  Payload ID: 2107
  Gene Symbol: CIB2
  Gene Name: calcium and integrin binding family member 2
  Uniprot ID: O75838
  ENST ID: ENST00000539011
  CDS Start-End: 415-849
aagggttcgtgccgggcagcgtctcccggggccaggtcgcctcctgccgggacccgggcgcgctgcagccgcggagccgggtgccccgccctcttcccgccggcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccccaaagagggaaaagcagataacccaacaggaggtggtggggtctgacgtgtccaagtgctggcagacaccctggtcacccaggacagagcggaaaaaaaaaaaagaggtcagggttttaacgagctatgcaatctttttccaaaacccaaggttgggctgcttcccacccctgcctgttccccttctcccggcctccttcacaatgtgaagctgtgggtgcagtgggcccaagggctcttgctcctgtctctgcctctgggtcatgagtaccaccctgcctgcctccccaacaccgtggaatcctcactggtgtgctgtccacagatttgtgaactcctggtagtaaaacacttttgcatccc

SEQ ID NO: 112987 - DNA, 804 bp, Homo sapiens
  Payload ID: 2107
  Gene Symbol: CIB2
  Gene Name: calcium and integrin binding family member 2
  ENST ID: ENST00000560618
  CDS Start-End: 143-646
tgatgggagtcggagcccgggcgggcgagcggcggcgcggcggccaccatggggaacaagcagaccatcttcaccgaagagcagctagacaactaccaggctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcaggtgctgccactacaggggccgggcttgggcagggcagagcagggcaggccgggatgttggggctgaggcccctatcactcgctatttgtgagcagtggtgtgcggccaggaagcaggaggtcacgttcaagccacccttgccctagacgtgtgactggcctttgtcccctgcagggggaaggttgaagacctgggggccccttcagtgataagtgggggcagaactccctgggcaccgctgttcctccg

SEQ ID NO: 112988 - DNA, 462 bp, Homo sapiens
  Payload ID: 2107
  Gene Symbol: CIB2
  Gene Name: calcium and integrin binding family member 2
  ENST ID: ENST00000559645
  CDS Start-End: 21-462
gcggcggcgcggcggccaccatggggaacaagcagaccatcttcaccgaagagcagctagacaactaccaggactgcaccttcttcaataagaaggacatcctcaaatggggaaaccgaggctcagagggatttggtcactcctccagggtcacacaggctgtccacagtctggctccggggccctcctgcttatcctgcacccacagtgattgctgtgtgtgttttcttcaggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgagg

SEQ ID NO: 112989 - DNA, 390 bp, Homo sapiens
  Payload ID: 2107
  Gene Symbol: CIB2
  Gene Name: calcium and integrin binding family member 2
  ENST ID: ENST00000561190
  CDS Start-End: 11-390
ggcggccaccatggggaacaagcagaccatcttcaccgaagagcagctagacaactaccaggactgcaccttcttcaataagaaggacatcctcaagctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgcactttccacatccggatctgaggacactgccga

SEQ ID NO: 112990 - DNA, 443 bp, Homo sapiens
  Payload ID: 2107
  Gene Symbol: CIB2
  Gene Name: calcium and integrin binding family member 2
  ENST ID: ENST00000559054
  CDS Start-End: 280-443
gcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagtagatccgattgctccccaggacacagctcctgcattcccacattgaggccgagtgggcagcccaccctattcagtcaccttgctttttataggctgcattcgcgattctatgagctggcccccaacctcgtcccaatggactacaggaagagccccatcgtccacgtgcccatgagcctcatcatccagatgccagagctccgggagaatcccttcaaagaaaggatcgtggcggcgttttccgaggatggtgaggggaacctcactttcaacgactttgtggacatgttttccgtgct

SEQ ID NO: 112991 - DNA, 934 bp, Homo sapiens
  Payload ID: 2107
  Gene Symbol: CIB2
  Gene Name: calcium and integrin binding family member 2
  Uniprot ID: O75838
  ENST ID: ENST00000557846
  CDS Start-End: 219-635
gcggcggagtcgctgccgctccgggttcccgtccccgcctccgagacccccgcgcgcctcctccaggcgagctgcggggcgggaagggtccggccaccgtgggccgctgccagccgcggggctgccgagggccgcgggcacggggcgctggctccgggtctggcggccgctgatgggagtcggagcccgggcgggcgagcggcggcgcggcggccaccatggggaacaagcagaccatcttcaccgaagagcagctagacaactaccaggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatcctgtggccctttcagcaaaaaaaaaaccttaaccaggaagggggcctgtgaaggttaggacccttcccacagccccgctgtggtccagccccgggacccatggcctctctccaggccctccgcaccccgccccatgccccagtcctttcctactccagaaatgctccccacccccc

SEQ ID NO: 112992 - DNA, 669 bp, Homo sapiens
  Payload ID: 2107
  Gene Symbol: CIB2
  Gene Name: calcium and integrin binding family member 2
  ENST ID: ENST00000557818
  CDS Start-End: 1-147
cgattctatgagctggcccccaacctcgtcccaatggactacaggaagagccccatcgtccacgtgcccatgagcctcatcatccagatgccagagctccggggatcttgtccaaatgccaattcaggctcagtacatgtggagtagagtcaggattctgcttttcgagcaagttcccaggagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggcctagaagtccaccatcctgccctgcagtcacatgggtgtggcctccaagctccccaggaaagcagtggcagcctctggggtttacaccacaaatatatc

SEQ ID NO: 112993 - DNA, 535 bp, Homo sapiens
  Payload ID: 2107
  Gene Symbol: CIB2
  Gene Name: calcium and integrin binding family member 2
  ENST ID: ENST00000557917
  CDS Start-End: 57-335
gcggccgctgatgggagtcggagcccgggcgggcgagcggcggcgcggcggccaccatggggaacaagcagaccatcttcaccgaagagcagctagacaactaccaggactgcaccttcttcaataagaaggacatcctcaagagaatcccttcaaagaaaggatcgtggcggcgttttccgaggatggtgaggggaacctcactttcaacgactttgtggacatgttttccgtgctctgcgagtcggctccccgagagctcaaggcaaactatgccttcaagatctatgacttcaacactgacaacttcatctgcaaggaggacctggagctgacgctggcccggctcactaagtcagagctggatgaggaggaggtggtgcttgtgtgcgacaaggtcattgaggaggctgacttggacggtgacggcaagctgggctttgctgacttcgaggacatgattgccaaggcccctgacttcctcagcactttccacatccggatctgaggacactgccgaggctgtaggggccta

SEQ ID NO: 112994 - DNA, 711 bp, Homo sapiens
  Payload ID: 2108
  Gene Symbol: CIB3
  Gene Name: calcium and integrin binding family member 3
  Uniprot ID: Q96Q77
  ENST ID: ENST00000269878
  CDS Start-End: 51-614
agctgggagcctttggggtgcatccccaagtctgggctgtggttcacaccatgggcaacaagcagacagtcttcacacacgagcagctggaagcgtatcaggactgcacatttttcacaaggaaggagatcatgaggctcttctatcgctaccaggacctggccccacagctcgtgcccctcgactataccacctgccccgatgtgaaggtgccctacgagctcattggcagcatgcccgagctgaaggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaactgacgcggggggggctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctgatggcaccacagaggagccgagctataggagggcggggtgacccctcacccgctgtggactctggtttctgagaataaacacaagtcactgagtcaca

SEQ ID NO: 112995 - DNA, 467 bp, Homo sapiens
  Payload ID: 2108
  Gene Symbol: CIB3
  Gene Name: calcium and integrin binding family member 3
  Uniprot ID: Q96Q77
  ENST ID: ENST00000379859
  CDS Start-End: 1-417
atgggcaacaagcagacagtcttcacacacgagcagctggaagcgtatcaggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaactgacgcggggggggctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctgatggcaccacagaggagccgagctataggagggcggggtgacccctcaccc

SEQ ID NO: 112996 - DNA, 595 bp, Homo sapiens
  Payload ID: 2108
  Gene Symbol: CIB3
  Gene Name: calcium and integrin binding family member 3
  ENST ID: ENST00000597251
  CDS Start-End: 1-138
atgggcaacaagcagacagtcttcacacacgagcagctggaagcgtatcaggactgcacatttttcacaaggaaggagatcatgaggacctggccccacagctcgtgcccctcgactataccacctgccccgatgtgaaggtgccctacgagctcattggcagcatgcccgagctgaaggacaaccccttccgccagaggattgcccaggtattctctgaggatggggatggccacatgaccctggacaactttttggacatgttttccgtgatgagtgaaatggctccccgcgacctcaaggcttactatgcttttaaaatttatgattttaacaacgacgactacatttgtgcgtgggacctggagcagacggtgaccaaactgacgcggggggggctgagtgccgaggaggtgagcctggtatgtgagaaggtgctggatgaggctgatggagaccatgatgggcggctgtccctggaagatttccagaacatgatcctccgggcaccagacttcctcagcaccttccacatccgaatctgatggcaccacagaggagccgagctataggagggcggggtgacccctcaccc

SEQ ID NO: 112997 - DNA, 773 bp, Homo sapiens
  Payload ID: 2109
  Gene Symbol: CIB4
  Gene Name: calcium and integrin binding family member 4
  Uniprot ID: A0PJX0
  ENST ID: ENST00000288861
  CDS Start-End: 55-612
gcgagtccttgaggctgaggttctactgctggcagacagaaaggtgtggttggcatggggcaatgcttgaggtatcagatgcactgggaggacctggaagagtaccaggccctgaccttcctgaccagaaatgaaattctgtgcatccatgacaccttcctgaagctctgccctcctgggaagtactacaaggaggcaacgctcaccatggaccaggtcagctccctgccagctctgcgggtcaaccctttcagagaccgtatctgcagagtgttctcccacaaaggcatgttctcctttgaggatgtgctgggcatggcatctgtgttcagcgagcaggcctgcccaagcctgaagattgagtatgcctttcgcatctatgattttaatgagaatggcttcattgatgaggaggatctgcagaggatcatcctgcgactgctgaacagtgatgacatgtctgaggacctcctgatggacctcacgaaccacgtcctgagtgagtcggatctggacaatgacaacatgctgtccttctcagagtttgaacatgcaatggccaagtctccagatttcatgaactcctttcggattcacttctggggatgctgatgtagcggcaaacacctgacatggcagcctcgagggagaccacaggaatcgaaccccctccagcactggagggagctggtttgaagtatgactttgtactgggcccacactcacctctagaatattgtttattagataaaagaaaaagcttttccttagcc

SEQ ID NO: 112998 - DNA, 5866 bp, Homo sapiens
  Payload ID: 2110
  Gene Symbol: CALCOCO1
  Gene Name: calcium binding and coiled-coil domain 1
  Uniprot ID: Q9P1Z2
  ENST ID: ENST00000262059
  CDS Start-End: 367-2439
aaaccagcagccacccctaatgcagccggccccctcctaagggatcatgggccttgaagtcctttgctggccacaccctcgttttctgtcataggagtgagaactacgcctcccaggatgccgcggtgaggccgccgtcacggacgccctcttccccgccctccttgcgcgcagccttctgggatgtatagtcctagatccgagcacgcagcggcaaaagggcgcagaagaaccacaaaccccagaagccctcgcgcccactcttctccctcccctccagaagtcggagtgctgtttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgtatgactgttgtcacaaaatgtgttcttatcatgaggtgtgactggaacacagggcccagacctccagctcttagaccctggtggagggaggagggaaagaggggacgcatccctgcctcatggcaggggatgctgggcagttactgtcctgtcgtgcctcctggtgtgctggccatgagtgggttgtctcaagtgggagtctggcttggataatgcggcagttggggagggagcaaactcatgggtccctgtcacttctgctcagggtttagtcccagggtgggtgcatgccatggaaaagtgggacaagtttcccactgccgagaacttcacccttcatagcagccatcactgtaccttatgccaaaggacaggctttattcctgtcaagagcgtacacctttgagtatctacttagtaaaaaatgccctaagcctcatacctctaaaggcgattttatattcctcctgtttctgtttctgtttctttctctgttgccatcccctcatacctgtatgcacactctgcctcaacagtcacaaaaacacattcatccactctaaccagcttcacaggctagacagacacatacacagcatcgtaaagcatttgttaaggacctgcacgctcaccaaggctctcagcaatggcctgcacaagcacatgcctacaaccccctcgtcctccaacccaatagctcccttctcagctgccctcctctcccttcagggcccctgtgtggaccacccccaccattccctttctccattcacctgaaatgctcctgtccaccccctttccagccccacctggatgacttcttacatcgttccttcttccctcacgtctccgtctcctagcaaccccatcccgttccctgaatcccttccaaggaaattagagataatggatctctcctctctccatcccaacccctctttattgatcctcctttaatgaaagttaattataacaatgatttaattaatagaatccctctcttcctttattgcttcccgtattaagactattaataaatacgagctgggctgacagaggcatccatcacccgcctgggattccccccatccctccttttaccttcccccctctccctctccctctcttggcctataaacttgccggggtagtgggggttaatcagagaggaattatgagccaacatccccagcaggaggtgcatttaatgaaatcatgtgtgatttattttctgggggaggttggggcgagaagaatctgggacccacacctcctggcttccagtgagtggctgccttgtgcaaaaaaggagaatagtagacaaacaggaacccaggcccctgctcccatgccacagcccctgccaagccgcacatacacccacaggagccacatggctagctgcacaaggccactgatacagacactgtcagactaaaagcacttaagaggactgcggtataggttttgttctttccaacctcgaaaacttcacatgggtccttctcacctccttcctttctctccagccctgttctgcttcactgtcccgaatctgcttcatactcccctcctccatgaagccccccaaccccccaccaggctcctcaacatggatatctagagtttctagctgctcctttctctgccctttgtgtgtctttctggcatgcaatttgcagtttcagactgggggtgccacaaaatgtggggccatttctcttccttactcatggtttgcctatcccagtatccaaagcatggtccccgacacagagggggctcaaggaagggtaattgacggcatgggctgggggaaacccaggggcagccagcttccaattctagttctctttcctactcactgaggggtatttggcaactcagcctttctacttatttctcttctataatggatcatccctttcctccctgctccccagcatccatgcaaaagccgatagatctgaatgggcttgagactctaatgtgaaaggagatgtcagccaagtagcagcaaataggaactcgcgtcagtatttggtggtgaaagaacgaatccaaacacaccactcccccacttatcgaacctcaatggccacctgttacctacaggaatgagaaatgtagattgcttagtgtgccagtcagggtcttcaccatctgtcccaacttgcccttccatttcccatctaccctaaggaaccctgtactccagtataacagaaccattccacaaaaacatacactactttcctcctagctcaaaggataccacctacatggagccttacttgactgccctcagttatcctttgacataccacgtagagcactttataaaaagatgctacatgtgtttacaactttttattctccctaaactgtaagcaacttgaaggcagattctatgcttatacatcactgtgttcctaaaatctagtatagagactggaacataggaccagtcctccagaaataatctttaagttattttaatgaaatgttttatacatacaaaataatatatgtaatgaataataaagtgaacatcattgagctcaccaactagcttcaaataaatattaccaataccattaaa

SEQ ID NO: 112999 - DNA, 2706 bp, Homo sapiens
  Payload ID: 2110
  Gene Symbol: CALCOCO1
  Gene Name: calcium binding and coiled-coil domain 1
  Uniprot ID: Q9P1Z2
  ENST ID: ENST00000430117
  CDS Start-End: 61-1881
gtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgt

SEQ ID NO: 113000 - DNA, 567 bp, Homo sapiens
  Payload ID: 2110
  Gene Symbol: CALCOCO1
  Gene Name: calcium binding and coiled-coil domain 1
  ENST ID: ENST00000548177
  CDS Start-End: 165-567
gtttttgttgttggtgaaaggtgaggggaacagctgatccgtctgttggtgtgtctccagctaccaatacaaacagatggaaggatggaggctgaggggagcagagagaaaatgaggagagaaatactaaagtgaaaccagaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatg

SEQ ID NO: 113001 - DNA, 746 bp, Homo sapiens
  Payload ID: 2110
  Gene Symbol: CALCOCO1
  Gene Name: calcium binding and coiled-coil domain 1
  ENST ID: ENST00000549784
  CDS Start-End: 298-746
acggacgccctcttccccgccctccttgcgcgcagccttctgggatgtatagtcctagatccgagcacgcagcggcaaaagggcgcagaagaaccacaaaccccagaagccctcgcgcccactcttctccctcccctccagaagtcggagtgctgtttttgttgttggtgaaaggtgaggggaacagctgatccgtctgttggagattagttgctgctttctgatgtcataactcattcctggatacagctgggtcaacaagcttaggagtaggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttaca

SEQ ID NO: 113002 - DNA, 3888 bp, Homo sapiens
  Payload ID: 2110
  Gene Symbol: CALCOCO1
  Gene Name: calcium binding and coiled-coil domain 1
  Uniprot ID: Q9P1Z2
  ENST ID: ENST00000548263
  CDS Start-End: 50-1951
ggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccaggtgagttcaaccagcaaggccaggagggaggtgggaggaggtcagagggaaagggcatctgtgtggacagtcaccaggccctgctcccaacccctgcccttcttggcctcagccaagaaaaggagatacaggtatggttaacaaggaaaatgactcactgctccaaatcccagatgccttcaggtaatccctacccctatcttatcaatgcactcagaggtcctgcctttaactggcttctatgttgttctagcaccatcttctgcagagcccaaattgccctgcttcccctctctcctgcctctaccccttccccaaccaccaggtaggtacctagggtcctccggggaggaagggaggtgaccatggcccccagggataggagcagagagaagactgggatccagcatccatctggctacaactgaaatgctttccctcttccctgacttccctgggtaacccttagggaagggaacctatagaggtgggggtttcaggtatcagattgtccccttctgccttcccttttattcccaggttcaagggggcaggcacagggaagagagatttgatcatctagtcccggttttgcctggatgtgagatgggctcagggcagggagggggtgatgctgtcatccttctcggctggagcaggaagatgaaggacgatgtcagactcattttcagcctcattaggcagcagacggagatggagggaggagagcaggaggctgggggatgggctctgcactgcagagaccagcagggactaaagaagagaggacatggggaactggaaaaataagccttccaggattgtggggagaaagacgctgtgggagaggccaggatgctgcattaggcacaggataacctgggaacccaggcacatgggtcctgctctccgaagtctgcaagtcaagaagggaacagagcacgccgaccctctccctttcccctctgtctctcttagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatcc

SEQ ID NO: 113003 - DNA, 551 bp, Homo sapiens
  Payload ID: 2110
  Gene Symbol: CALCOCO1
  Gene Name: calcium binding and coiled-coil domain 1
  ENST ID: ENST00000552623
  CDS Start-End: 192-551
ctgtagtgtgtctccagctaccaatacaaacagatggaaggatggaggctgaggggagcagagagaaaatgaggagagaaatactaaagtgaaaccaagattagttgctgctttctgatgtcataactcattcctggatacagctgggtcaacaagcttaggagtaggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagag

SEQ ID NO: 113004 - DNA, 549 bp, Homo sapiens
  Payload ID: 2110
  Gene Symbol: CALCOCO1
  Gene Name: calcium binding and coiled-coil domain 1
  ENST ID: ENST00000546619
  CDS Start-End: 71-549
gtttttgttgttggtgaaaggtgaggggaacagctgatccgtctgttgggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacg

SEQ ID NO: 113005 - DNA, 554 bp, Homo sapiens
  Payload ID: 2110
  Gene Symbol: CALCOCO1
  Gene Name: calcium binding and coiled-coil domain 1
  ENST ID: ENST00000549173
  CDS Start-End: 73-554
tttttgttgttggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaaggtacaagggaagatggaaaattgggagagaggagccaagggagtggaggtttgaaagaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgct

SEQ ID NO: 113006 - DNA, 549 bp, Homo sapiens
  Payload ID: 2110
  Gene Symbol: CALCOCO1
  Gene Name: calcium binding and coiled-coil domain 1
  ENST ID: ENST00000549688
  CDS Start-End: 236-549
ctgtagtgtgtctccagctaccaatacaaacagatggaaggatggaggctgaggggagcagagagaaaatgaggagagaaatactaaagtgaaaccagtaggtttctagtcctgctgcaggcacagtctggagagaagaatagattagttgctgctttctgatgtcataactcattcctggatacagctgggtcaacaagcttaggagtaggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccg

SEQ ID NO: 113007 - DNA, 2291 bp, Homo sapiens
  Payload ID: 2110
  Gene Symbol: CALCOCO1
  Gene Name: calcium binding and coiled-coil domain 1
  Uniprot ID: Q9P1Z2
  ENST ID: ENST00000550804
  CDS Start-End: 62-2137
ggtgaaaggtgaggggaacagctgatccgtctgttgggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgcagctgaagctacagctggagggacaggtgacagagctgaggagccgagtgcaggagctcgagagggctctggcaactgccaggcaggagcacacggagctgatggaacagtacaaggggatttcccggtcccatggggagatcacagaagagagggacatcctgagccggcaacagggagaccatgtggcacgcatcctggagctagaggatgacatccagaccatcagtgagaaagtgctgacgaaggaagtggagctggacaggcttagagacacagtgaaggccctgactcgggaacaagagaagctccttgggcaactgaaagaagtacaagcagacaaggagcaaagtgaggctgagctccaagtggcacaacaggagaaccatcacttaaatttggacctgaaggaggcgaagagctggcaagaggagcagagtgctcaggctcagcgactgaaagacaaggtggcccagatgaaggacaccctaggccaggcccagcagcgggtggccgagctggagcccttgaaggagcagcttcgaggggcccaggagcttgcagcctcaagccagcagaaagccacccttcttggggaggagttggccagtgcagcagcagccagggaccgcaccatagccgaactacaccgcagccgcctggaagtggctgaagttaacggcaggctggctgagctcggtttgcacttgaaggaagaaaaatgccaatggagcaaggagcgggcagggctgctgcagagtgtggaggcagagaaggacaagatcctgaagctgagtgcagagatacttcgattggagaaggcagttcaggaggagaggacccaaaaccaagtgttcaagactgagctggcccgggagaaggattctagcctggtacagttgtcagaaagtaagcgggagctgacagagctgcggtcagccctgcgtgtgctccagaaggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatccca

SEQ ID NO: 113008 - DNA, 586 bp, Homo sapiens
  Payload ID: 2110
  Gene Symbol: CALCOCO1
  Gene Name: calcium binding and coiled-coil domain 1
  ENST ID: ENST00000549349
  CDS Start-End: 240-586
gtgctgtttttgttgttggtgaaaggtgaggggaacagctgatccgtctgttggtgtgtctccagctaccaatacaaacagatggaaggatggaggctgaggggagcagagagaaaatgaggagagaaatactaaagtgaaaccaagattagttgctgctttctgatgtcataactcattcctggatacagctgggtcaacaagcttaggagtaggaggacagatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagccccccttt

SEQ ID NO: 113009 - DNA, 559 bp, Homo sapiens
  Payload ID: 2110
  Gene Symbol: CALCOCO1
  Gene Name: calcium binding and coiled-coil domain 1
  ENST ID: ENST00000551900
  CDS Start-End: 66-559
gtttttgttgttggtgaaaggtgaggggaacagctgatccgtctgttggatatctcaaggccaggatggaagaatcaccactaagccgggcaccatcccgtggtggagtcaactttctcaatgtagcccggacctacatccccaacaccaaggtggaatgtcactacacccttcccccaggcaccatgcccagtgccagtgactggattggcatcttcaaggtggaggctgcctgtgttcgggattaccacacatttgtgtggtcttccgtgcctgaaagtacaactgatggttcccccattcacaccagtgtccagttccaagccagctacctgcccaaaccaggagctcagctctaccagttccgatatgtgaaccgccagggccaggtgtgtgggcagagcccccctttccagttccgagagccaaggcccatggatgaactggtgaccctggaggaggctgatgggggctctgacatcctgctggttgtccccaaggcaactgtgttacagaaccagctcgatgagagccagcaagaacggaatgacctgatgca

SEQ ID NO: 113010 - DNA, 1523 bp, Homo sapiens
  Payload ID: 2110
  Gene Symbol: CALCOCO1
  Gene Name: calcium binding and coiled-coil domain 1
  ENST ID: ENST00000546443
  CDS Start-End: 1-698
aggaaaaggagcagttacaggaggagaaacaggaattgctagagtacatgagaaagctagaggcccgcctggagaaggtggcagatgagaagtggaatgaggatgccaccacagaggatgaggaggccgctgtggggctgagctgcccggcagctctgacagactcagaggacgagtccccagaagacatgaggctcccaccctatggcctttgtgagcgtggagacccaggctcctctcctgctgggcctcgagaggcttctccccttgttgtcatcagccagccggctcccatttctcctcacctctctgggccagctgaggacagtagctctgactcggaggctgaagatgagaagtcagtcctgatggcagctgtgcagagtgggggtgaggaggccaacttactgcttcctgaactgggcagtgccttctatgacatggccagcaccatcttctgcagagcccaaattgccctgcttcccctctctcctgcctctaccccttccccaaccaccagtggctttacagtgggtaccctgtcagaaaccagcactgggggccctgccacccccacatggaaggagtgtcctatctgtaaggagcgctttcctgctgagagtgacaaggatgccctggaggaccacatggatggacacttctttttcagcacccaggaccccttcacctttgagtgatcttactccctcgtacatgcacaaatacacactcatgcacacacacactcacacacatgcatacacttaggtttcatgcccattttctatcacactgggctccatgatattctgttccctaagaactgcttctgtgtgccctgttttcatcccaagatttctcacttcatcctctcctacctggctcttttgtcccagggaggggtcctgttcggaagcagtggctgaatttatcccctgaaagtggttttggaggaaccgggatggaggaggccttcccctgtgggaatagaatcgtccactcctagccctggttgcttctgatacacagccactgcacacacacactcacactcacactcccttgtctgatgccccaaagccaattcctggggcaccctaccctctcttatttggagtttccgttggtttacctgagttttctctggggtctgcacagaggcagcagcatggacatcatggcctctcaggtcccttttggttctcagtttcattggttcctctttctgttcccccattgacttctgtgccccaccctagccttttccataaccttaggtattcagtttggaggggttttttgtatttttgaggattcctgtattctgtatcctctcctcgcatctcctcacatggaaagaaataatgtatttgtgccttctgtgaggaatggggggaacaagtggtcccaggtatccccatttccaaggcccccctccctctccaggtccccccacagcaataaaagcttccccctgatatccatccctttgtagtttgaacaaatatatttatatgatatgt

SEQ ID NO: 113011 - DNA, 3682 bp, Homo sapiens
  Payload ID: 2111
  Gene Symbol: CALCOCO2
  Gene Name: calcium binding and coiled-coil domain 2
  Uniprot ID: Q13137
  ENST ID: ENST00000258947
  CDS Start-End: 102-1442
caggcgggacgggctctcccttgggtgcttagccccgcccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttggtgttgctttctccaaatgattgttttagactagccaaaaatgccgtggcaaagagctcagaaatccaatttggataccaaaggtttctcatgttaatttctcagcccccaaagaagcatcttactcctgaaccttagacaggaagtattgtttcagtcacagaaagcttttctgggtacctctggttagcactttctactctctgatatttcctatgtacatagcttttattgttgtaaatcctttcttaatggttaaataggattgttagcaactatgggtttgcagttttctgagtaggtgagttttgaatatgggtaaatcagaataatgagacaacttgttaatctctttaatactaaaaataaattactcttctatttcagggacttaggtaatttaaaataaaccttcaatttatggtcttctgttttgaagctcatgggaaaattgtgatcaaaagggctatgggaagggcagaccccgccaatgatttctcttcacctgtcttaagattaaataaaaaagagtgtcctggcagttatcttgaggtggggaaggaggtgatgaaacattagtttgtgaaatccaaggccctggcttgctttctttctttttttttttttttttttgaaacagtctctctctgtcacccaggctggcgtgcaatggcgcagttgactcactacagcctctgcctcccaggttcaagcgattctcatgccttagcctcccaagtagctgggattacaggtgtgtgccgcaatgcccagctaatttttgtgtttttagtagagacagggtttcactatgttggccaggctggtctcgaactcctggcctcacgtgatctgtccacttcagccgtccaaagtgctgggattacaagcgtgagccactgtgctgggcccgaggccctgacttcttgctgtaactttccatgcattttttttaaaaggagcagtgtggattttcgcaccctttgtgaactaagttcaatgcgctctatccaaatttgcctaattgaactataagaaagtaataattccattttctatcccctcagggactgaacaaatggaaataactcccaggcagtatcaggtggtcactacagagacttccacaaaaacttttgaatgatgtgaaacacgatgtcatgaataagggttgagccaactatagctctgtgttcctactgggctttccctaatgtggttgggagttatgccctagactaactgtattgtcctagtcacagctccttgctttgatttcatccttgataaaatgaagatgaaacttacactacttctccaagccttttgctgtcttaagaataagacctgagattaacactaaccctagaatagaaatgtaatagggagatggtaataaaggagtttttctggcacataccctccctacagaatttctgttgctccccagatccagtgaagaattgcagtttcatttattttgtaccagtcagctcttaattaagtacatgaatggagaggaacagtggtgcacataatccaaatcagtgaataccattttctggtgaattacccacccctttgcccctgctaccccgagggttaccatgattgtcaacagcagcaggagcccttccacagggcttggtaaaaaaaccagttgaggtgttaatgaccctttttgctgggtgtaaaacaaagcatctttaaccactgttcattatccccagctgctcttaccaaggctttgaagggggaaattatgctctaggcagccactagtagtaaacaat

SEQ ID NO: 113012 - DNA, 1916 bp, Homo sapiens
  Payload ID: 2111
  Gene Symbol: CALCOCO2
  Gene Name: calcium binding and coiled-coil domain 2
  Uniprot ID: Q13137
  ENST ID: ENST00000448105
  CDS Start-End: 56-1468
cactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagcatttaaatgtttccaagacaaattggaacaagaactactcaaatggaggagccaaggacagaaattgcaggtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataactctagctgtatcatcctctcacctgtcattcttctgagggtctcagtacaagggccctgggatggagccaacctgggtattcacaacaggcctgacttgatactaagtgattagttttccaagttgtcccactgccattcaaagtcagcccttgagtgtatttgttctcagtcctaaccctggggccagagattggtccgaggttgagaattccttcctcctcatccttgg

SEQ ID NO: 113013 - DNA, 1438 bp, Homo sapiens
  Payload ID: 2111
  Gene Symbol: CALCOCO2
  Gene Name: calcium binding and coiled-coil domain 2
  Uniprot ID: Q13137
  ENST ID: ENST00000416445
  CDS Start-End: 55-1269
actctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaa

SEQ ID NO: 113014 - DNA, 495 bp, Homo sapiens
  Payload ID: 2111
  Gene Symbol: CALCOCO2
  Gene Name: calcium binding and coiled-coil domain 2
  ENST ID: ENST00000505071
  CDS Start-End: 34-495
gccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagttctggcctacagcctgtctgtcatacggagaggtggaagagatt

SEQ ID NO: 113015 - DNA, 1396 bp, Homo sapiens
  Payload ID: 2111
  Gene Symbol: CALCOCO2
  Gene Name: calcium binding and coiled-coil domain 2
  Uniprot ID: Q13137
  ENST ID: ENST00000508679
  CDS Start-End: 81-1205
actctgccctgttgctgtcgcgccgctgctggttgctgtccctggtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgt

SEQ ID NO: 113016 - DNA, 561 bp, Homo sapiens
  Payload ID: 2111
  Gene Symbol: CALCOCO2
  Gene Name: calcium binding and coiled-coil domain 2
  ENST ID: ENST00000507306
  CDS Start-End: 1-388
gcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatgtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccctgctgccgctaacagtggagttatgtcactgatctgaaggtcactgttaagggcttctgctgccatccttgtgggttgctacctttaagtcgcataa

SEQ ID NO: 113017 - DNA, 767 bp, Homo sapiens
  Payload ID: 2111
  Gene Symbol: CALCOCO2
  Gene Name: calcium binding and coiled-coil domain 2
  ENST ID: ENST00000507076
  CDS Start-End: 686-767
tctgaaggccctggagcccctcccgcggcccgggagggttgcggggcagttttgtcttgcggagggcagcgctgcagtgctgtgtggcagggtgggaggctcctcgggaagaagtgacacccctggcggcggcgagggtcttgaggcggcggctgccgccccacgggtcgtggcgtcccgtcccctcccgcgggcccaggctgtggtggttccgtaatccctcgcctggatgtcatcgccgttggcttcgaggcggaggtggagccttgttgcgtcaccctgagcaagttactttctttttgggcctcagtgtccccctttacgagtaggtttgatccctgaagcgccttgccttttgcatgctgcagctgtcggagaagacgttctaggcaggaggaaagacggtgtcgtgacctgcctctacagttaatccattgcccctccaccactgacccagcttagtttgggagctaatgttcccactcgtatattatttcaaccccactggacgtgttaactcttttctatcacttggattcttgcttcacatgcaagccaacaagtgaccatggttggagctgagtaaaatatggataatataacttattctattattggaaacaccattgcaagtaaaggactttatgtggtggggtggaagacaacccgtgagtattacaccttcatgtgggttactttgcccattgacctaaacaacaaatcagctaaacagcaggaagtccaattcaaagcttactacctgccca

SEQ ID NO: 113018 - DNA, 1512 bp, Homo sapiens
  Payload ID: 2111
  Gene Symbol: CALCOCO2
  Gene Name: calcium binding and coiled-coil domain 2
  Uniprot ID: Q13137
  ENST ID: ENST00000509507
  CDS Start-End: 64-1467
ccccgtcccactctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagatgtagtcttaatcagactattcaactcctcatcaccccagacactggtagtatctggcaccaggtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattggaaggagaaaatgatcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaa

SEQ ID NO: 113019 - DNA, 724 bp, Homo sapiens
  Payload ID: 2111
  Gene Symbol: CALCOCO2
  Gene Name: calcium binding and coiled-coil domain 2
  ENST ID: ENST00000502761
  CDS Start-End: 146-724
taatctcagtatttgtcaggattttgcttttcctgacttgctttgcacagaatgttccctggatgaaagcccagaaatcaccaacatttcagacaatgctttctgagccttactctgttccacatttcataacaggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaag

SEQ ID NO: 113020 - DNA, 973 bp, Homo sapiens
  Payload ID: 2111
  Gene Symbol: CALCOCO2
  Gene Name: calcium binding and coiled-coil domain 2
  ENST ID: ENST00000513119
  CDS Start-End: 195-973
actctgccctgttgctgtcgcgccgctgctggttgctgtccctggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactgaaagtgaaagaacagaaggactattgggagacagagctgcttcaactgaaagaacaaaaccagaagatgtcctcagaaaatgagaagatgggaatcagagtggatcagcttcaggcccagctgtcaactcaagagaaagaaatggagaagcttgttcagggagatcaagataagacagagcagttagagcagctgaaaaaggaaaatgaccacctctttctcagtttaactgaacagaggaaggaccagaagaagctcgagcagacagtggagcaaatgaagcagaatgaaactactgcaatgaagaaacaacaggaattaatggatgaaaactttgacctgtcaaaaagactgagtgagaacgaaattatatgtaatgctctgcagagacagaaagagagattgga

SEQ ID NO: 113021 - DNA, 558 bp, Homo sapiens
  Payload ID: 2111
  Gene Symbol: CALCOCO2
  Gene Name: calcium binding and coiled-coil domain 2
  ENST ID: ENST00000509415
  CDS Start-End: 55-558
actctgccctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaaccccttactacctgcccaaggatgatgagtattaccagttctgctatgtggatgaggatggtgtggtccggggagcaagtattcctttccaattccgtccagaaaatgaggaagacatcctggttgttaccactcagggagaggtggaagagattgagcagcacaacaaggagctttgcaaagaaaaccaggagctgaaggacagctgtatcagcctccagaagcagaactcagacatgcaggctgagctccaaaagaagcaggaggagctagaaaccctacagagcatcaataagaagttggaactg

SEQ ID NO: 113022 - DNA, 578 bp, Homo sapiens
  Payload ID: 2111
  Gene Symbol: CALCOCO2
  Gene Name: calcium binding and coiled-coil domain 2
  ENST ID: ENST00000509784
  CDS Start-End: 1-132
tttgacctgtcaaaaagactgagtgagaacgaaattatatgtaatgctctgcagagacagaaagagagattggaaggagaaaatgatgagcagaagtggtggtctgtaccagtgctggacccatgcttttgaagagggagaacagcagattgctcagttacatgggtctggattttaattctttgccgtatcaagtacctacttcagatgaaggaggcgcaagacaaaatccaggacttgcctatggaaacccatattctggtatccaagaaagttcttcccccagcccgctctccatcaagaaatgccctatctgcaaagcagatgatatttgtgatcacaccttggagcaacagcagatgcagcccctttgtttcaattgtccaatttgtgacaagatcttcccagctacagagaagcagatctttgaagaccacgtgttctgccactctctctgagtatcccaacctcttggatgtatacagagattttatagaatagaacctatagcttctaccatgagttatatgagtcaagatcctgcctaacctgaaattattagggatttactcagccct

SEQ ID NO: 113023 - DNA, 553 bp, Homo sapiens
  Payload ID: 2111
  Gene Symbol: CALCOCO2
  Gene Name: calcium binding and coiled-coil domain 2
  ENST ID: ENST00000570513
  CDS Start-End: 191-553
actctgccctgttgctgtcgcgccgctgctggttgctgtccctgtctcactctgtcccccaggctggagtgcagtggcatgatcttggctcactgcaacctctgcctcctgggttcaagcggttctcctgcctcagcctcctgagtagctgggattacaggtgcctgccatcgtgcccgggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagagtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtatt

SEQ ID NO: 113024 - DNA, 575 bp, Homo sapiens
  Payload ID: 2111
  Gene Symbol: CALCOCO2
  Gene Name: calcium binding and coiled-coil domain 2
  ENST ID: ENST00000576582
  CDS Start-End: 47-373
ctgttgctgtcgcgccgctgctggttgctgtccctggacccctaccatggaggagaccatcaaagatccccccacatcagctgtcttgctggatcactgtcatttctctcaggtcatctttaacagtgtggagaagttctacatccctggaggggacgtcacatgtcattataccttcacccagcatttcatccctcgtcgaaaggattggattggcatctttagaagacagagtttcgttctgttgcccaggctggagtgcaatggcgcaatctcggctcaccgcaacctccgcctcccaggttcaagcgattctcctgcctcagcctcccgagtagctgggattacaggtggggtggaagacaacccgtgagtattacaccttcatgtgggttactttgcccattgacctaaacaacaaatcagctaaacagcaggaagtccaattcaaagcttactacctgcccaaggatgatgagtattaccagttctgctatgtggatgaggatggtgtggtccggggagcaagtattcctttccaattccgtccagaaaatgaggaagacatcctggtt

SEQ ID NO: 113025 - DNA, 770 bp, Homo sapiens
  Payload ID: 2112
  Gene Symbol: CABP1
  Gene Name: calcium binding protein 1
  Uniprot ID: Q9NZU7
  ENST ID: ENST00000351200
  CDS Start-End: 132-635
ccgtcctggaggaagaacggcacagacggagggaggctggggttggcagagactgggacggaagtccctcagtcccccaggagcctccttcatggacccggggatcccaagaggggctgcctcaacttaggatgggcaactgtgtcaagtatccactgagaaatctctcaaggaaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggagg

SEQ ID NO: 113026 - DNA, 1369 bp, Homo sapiens
  Payload ID: 2112
  Gene Symbol: CABP1
  Gene Name: calcium binding protein 1
  Uniprot ID: Q9NZU7
  ENST ID: ENST00000288616
  CDS Start-End: 554-1237
cggcaggcaccctggcttcgggaacccaaactagccagcttccctttctgggcctgctggcctaattcccagccgcagctgccattctgggcccccctccctgaggccatctccctgcagatttggcagcggggaaaggaggggccgagagaaggggagagaaccagagacaggactgagcgctaatctgatgtagatgatccggcagccttctccagcttggttcccctctgccatcagctctccaggtgactttccctgtgccctgcactctccccttctgctttcatctccttaagaaagtgcccagaaagttaaacccacacacaaacacacacacaatccacccaaaaaaaaaaaaaatcggagagcaggagcaggcagacgagtaagagagcacgcgcgcaagagagggctcacatccgtcctggaggaagaacggcacagacggagggaggctggggttggcagagactgggacggaagtccctcagtcccccaggagcctccttcatggacccggggatcccaagaggggctgcctcaacttaggatgggcaactgtgtcaagtatccactgagaaatctctcaaggaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccgggg

SEQ ID NO: 113027 - DNA, 1658 bp, Homo sapiens
  Payload ID: 2112
  Gene Symbol: CABP1
  Gene Name: calcium binding protein 1
  Uniprot ID: Q9NZU7
  ENST ID: ENST00000316803
  CDS Start-End: 135-1247
gggcggggcgcggcggtacctgggccgccagggagccgggggtgggctctccggggacagccggcagcgcccccagatctgcaccgccagccgccgggagctccgggctccgggcgtagaggctgcgctgtcacatgggcggcggcgacggggccgcatttaagcggccgggggacggcgcccgcctccagcgcgtcctcgggcttggctcccgccgggagccccgttctctgcccgccgggggccccgcgccgcgccgcaccgcgccgcccccgccgggccatgcgagcgcgggccccgccgcgatgagctcgcacatcgccaaaagcgagtccaagacgtcgctgctgaaggcggcggcggcggcggcgagcgggggcagccgggctccccgccacggccctgcccgggacccggggctgcctagccgccggctacccggctcctgcccggcgacgccgcagtcgtccggggaccccagttcgcggaggcccctgtgccggccggcgccgcgagaggagggcgcgcgggggagccagcgtgtgctcccccaggcgcactgcaggccccgggaggcgctgccggccgcggcgtcccgaccttcgccgtcgtcgccgctgccgccggcccgcgggcgggatggggaggaacggggactgtccccggcgctcggcctccggggctctctgcgagcccggggccgcggggactccgttccagccgccgcgtccgaggcggacccgttcctccaccggctgcgccccatgctcagctccgcctttggccaggatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaata

SEQ ID NO: 113028 - DNA, 1857 bp, Homo sapiens
  Payload ID: 2112
  Gene Symbol: CABP1
  Gene Name: calcium binding protein 1
  ENST ID: ENST00000453000
  CDS Start-End: 513-1433
ggtgggtgcctgtaaaccaagctactcaggaggctgaggcaggagaatcacttgaatccgggagtcagaggttgcagtgagccaagatcacgccactgcactccagcctgggcgacagagtgcactagccacacacgaaaaaggagggggcatgtttccactttgccccagtccccacctctcacaccctgcctgcttcatttatgtcagcaatggcacctgcatgtgcaacctctggtctggcagaccagccaagcctggtctccatgctgccagctccgattgccctcactgccttccagcggggatctggctggagtaggacaagtctgtttgggagctgggaggaatgacttagccctggagattgactgaattgggaggttgggagcattttgggaaaggatgttgtctcattaggctctgagtgaacacttcccattggtgagaatagaagccccccgctgcccctgtctcttcatgcacttgggtgtgtgattctgtgcatatgtatgtgccagtgcgtgcgtgcgtgtgtgtgtgtgtgtgtgtgcgcatgtgccacacagagggcatcacattcagctctccccggaaccaccatttccgtcaaggattggagactctgtctgttggaccaatttgatgcctgtgcacgctcagggctctctgaaccccgctccttgactctcagggtcccctcttgcggaaagcccctcccgggaccaggagccaggctgggcagggaggtgacaccctgcctctcttttgcatttgcttggtgctggctgaagatgtgccaggaggaacagaccagctacatggtggtgcagacgagcgaggaggggctggcggctgacgccgagctcccgggaccgctcctgatgctggcccagaactgcgcagtcatgcacaacctgctgggccctgcctgcattttcctgcgcaagggcttcgctgagaacaggcagcctgatagatcactgcgaccagaggaaattgaagagctccgagaggccttcagagaattcgacaaggacaaggatggctacatcaactgccgggatctgggcaactgcatgcgcaccatgggctacatgcccaccgagatggagctcatcgaactgtcccagcagatcaacatgaacctgggtggccatgtagattttgatgacttcgtggagctaatggggcctaaactcctggcagagacagcagatatgattggtgtaaaggaactgcgagatgctttccgagagtttgacaccaatggtgatggggaaataagcaccagtgagctgcgagaggctatgaggaagctcctgggtcatcaggtgggacaccgagacatagaggaaattatccgagatgtggacctcaatggggatggacgagtggactttgaagagtttgtccggatgatgtcccgctgaggccgcgagggcccctccaggactgccaagctcccaaaggcggggctaagaggagctagagcttgcctcacccgctgtagccgccgagagcccaggatgtactggcggatggggcctgcctgcaccccggggaggcgcccaccccggacccccacccctccgcactgtgaaagactaactcctgcaactggaaagcgggggcgcccgccgacgaggaggccaccgtgccaagccggcagaggtcatgccaggcgccaagggccatgtgcccagctgctgctggctgggtgggccagggagcccgccagcagaccccacacagcatgtccgccccagggcaaagcctcccaccttcgctctgcgcccgtcccagctcgcctcagccctgttatctcagaaccaataaaaatatttccaagagcaa

SEQ ID NO: 113029 - DNA, 925 bp, Homo sapiens
  Payload ID: 2113
  Gene Symbol: CABP2
  Gene Name: calcium binding protein 2
  Uniprot ID: Q9NPB3
  ENST ID: ENST00000294288
  CDS Start-End: 71-733
aggcagcagcatccgccgaggcccacccgggccacccccggggttccaggcctggcatggttcagggcccatggggaactgtgccaagcggccctggcgccggggccctaaggaccccttgcagtggctcggctccccaccaaggggctcctgccccagccccagctccagccccaaggagcagggggaccccgcgccaggcgtccagggctactcggtgctcaacagcctggtggggcctgcctgcatcttcctgcggcccagcattgccgccacccaactcgaccgggagctgcggcccgaggagattgaagagctgcaggtcgccttccaggagtttgaccgagaccgggacggctacattggctgccgggagctgggtgcctgcatgcggaccctgggctacatgcccaccgagatggagctcatcgagatctcacaacaaatcagtggcggaaaggtggactttgaagacttcgtggagctgatgggccccaagctgctggcagagacggcagacatgatcggtgtccgggagctacgggacgccttccgggagttcgacaccaatggggacggccgcatcagcgtgggcgagctccgggcggccctcaaggccctgctgggggagcgcctcagccagcgggaggtggacgagatcctccaggacgtggacctcaatggggacggtctggtcgacttcgaagagtttgtgcgaatgatgtctcggtgagcctgtacagaagctggaggcagcataaaggactcaaggaccacagcctctgcccaccagcatgttccttgaagcccatcgcctctagcggggaccctcctttcctccccatcccacctgtgtgcagtgcccttgcctgccttcacccccaccaccacttctccaataaagccgcctggccttgtctctgtc

SEQ ID NO: 113030 - DNA, 789 bp, Homo sapiens
  Payload ID: 2113
  Gene Symbol: CABP2
  Gene Name: calcium binding protein 2
  Uniprot ID: Q9NPB3
  ENST ID: ENST00000353903
  CDS Start-End: 71-562
aggcagcagcatccgccgaggcccacccgggccacccccggggttccaggcctggcatggttcagggcccatggggaactgtgccaagcggccctggcgccggggccctaaggaccgggagctgcggcccgaggagattgaagagctgcaggtcgccttccaggagtttgaccgagaccgggacggctacattggctgccgggagctgggtgcctgcatgcggaccctgggctacatgcccaccgagatggagctcatcgagatctcacaacaaatcagtggcggaaaggtggactttgaagacttcgtggagctgatgggccccaagctgctggcagagacggcagacatgatcggtgtccgggagctacgggacgccttccgggagttcgacaccaatggggacggccgcatcagcgtgggcgagctccgggcggccctcaaggccctgctgggggagcgcctcagccagcgggaggtggacgagatcctccaggacgtggacctcaatggggacggtctggtcgacttcgaagagtttgtgcgaatgatgtctcggtgagcctgtacagaagctggaggcagcataaaggactcaaggaccacagcctctgcccaccagcatgttccttgaagcccatcgcctctagcggggaccctcctttcctccccatcccacctgtgtgcagtgcccttgcctgccttcacccccaccaccacttctccaataaagccgcctggccttgtctctgtctctctgacaataaaatatctccaagcctggggaga

SEQ ID NO: 113031 - DNA, 960 bp, Homo sapiens
  Payload ID: 2113
  Gene Symbol: CABP2
  Gene Name: calcium binding protein 2
  ENST ID: ENST00000545205
  CDS Start-End: 103-321
tcgggagcagctgggggctggcaggagtcctcaggcagcagcatccgccgaggcccacccgggccacccccggggttccaggcctggcatggttcagggcccatggggaactgtgccaagcggccctggcgccggggccctaaggaccccttgcagtggctcggctccccaccaaggggctcctgccccagccccagctccagccccaaggagcagggggaccccgcgccaggcgtccagggctactcggtgctcaacagcctggtggggcctgcctgcatcttcctgcggcccagcattgccgccacccaactcgtatgaccgggagctgcggcccgaggagattgaagagctgcaggtcgccttccaggagtttgaccgagaccgggacggctacattggctgccgggagctgggtgcctgcatgcggaccctgggctacatgcccaccgagatggagctcatcgagatctcacaacaaatcagtggcggaaaggtggactttgaagacttcgtggagctgatgggccccaagctgctggcagagacggcagacatgatcggtgtccgggagctacgggacgccttccgggagttcgacaccaatggggacggccgcatcagcgtgggcgagctccgggcggccctcaaggccctgctgggggagcgcctcagccagcgggaggtggacgagatcctccaggacgtggacctcaatggggacggtctggtcgacttcgaagagtttgtgcgaatgatgtctcggtgagcctgtacagaagctggaggcagcataaaggactcaaggaccacagcctctgcccaccagcatgttccttgaagcccatcgcctctagcggggaccctcctttcctccccatcccacctgtgtgcagtgcccttgcctgccttcacccccaccaccacttctccaataaagccgcctggccttgtctctgt

SEQ ID NO: 113032 - DNA, 3826 bp, Homo sapiens
  Payload ID: 2114
  Gene Symbol: CAB39
  Gene Name: calcium binding protein 39
  Uniprot ID: Q9Y376
  ENST ID: ENST00000258418
  CDS Start-End: 430-1455
gtgcgcacgtcaaagccgggctcgggccgcaagcggggcgaggggttcggggagcggcgcggcctgggagacacagagccttcaggcgccggggcgggggcacaggcgaagactaaggcggcgccgggccccacagcagcagccgcagcccaagcgagcgcagcagcgcggcggcagccgcgggagcccctgggcagccgtccgcccgcgcagccgccgccgccgcgggagcccgtcgccgggagcaggagcgggcggaagacaacggaggggccgagcgtccgagccactccgcggggaccgaacgagcagcccgaagcggcggcggccgaggacggggacagcgacgacgcggaggcagagaagggaacgcccggcccagccccgtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgtatatatgcttttcacagctttctagaattttttgacatttgattttcttgagacttgtaaacctggatatgttgaagggtatttgttaattttacttttcaaagatactttaaaacagtagagctagcaatgacaccttgcatttcatttcaacactgcttcaaggtttcttttgtatataattcttagaatgctcatttcttttaaatggtttaatttgtacagcagaggaatgttattgtagtagtatgtaactattacctaatactgagtttttgcaaaaaacaatgaatgctcatatgtaattgaaatacttcagatcacatgaaaatgctgatttaacatttaagtatcacagcattaaaagaaaaagaaagtaaaccagtcctttgtattcagttacctaatggggtgccatcaataagctgcgatacagccctggagctcagtcagccacaccttcctgcatcctattggccttattcattttaaatgagttaatgaatctgccagatctgtgaatgatagagattatgctaaattaatgctgattctttgtgtgtgtgggaaatctctgtagagcaccttttctttcttagactaagtaacccagtacaatagttgtgaactgaataattaaaactttggcttctcttaggaaaagacgacttcctagtcataggtgtcctatggggaaatttattttttttaatgtcctgttccttaatgctgcaaattatcagtatttataaagtaactgattttgcaccacttttttgttactgtgaccacggcagaacaatgtcttctagactatatctatgtaaagttattagaatggtatctgttcattttagtgatatgaagatcacaactaacaactgacaaatcagagtttgccagttcaaattcagcatggctgcagctgattaagaaattgatatgattattctttgctagcctctcttactaatggaattatatactggccagtaaaatgggcctcccaattgctgtttcagcaggttttaaaccttcaggaacaccagttaggaaaatagctccagaaaatatagatatattttatttttattaaaatggcagtctacatcataattggcatttctcaagactgtctttaccagaatctgtgtgaaataaggcaatctagtctccttgaaaaaaaaatctcttggatgtttaggaaggaagacttggccgtgatgtggtgtcctggctttgtggtgtagtgctgtgtgtatggagttagtgtaaaaacatggattacaccaagtggaagaaacgtcttcttgccaagctcattcttagaacttacacatctagaacagcttccactttggcagtgaggtcgtagccttttaggtggaagaagtgagggtgcagcgtgtcagacacaacattcatgttactcttacattggaatctgaaggtagttcagacttcgtgggttttgtttttaagcaaaacaatgtgaaaacatttaagtttgaaatgttgcatttgaagttatgatcatttaatatattcatattaccaagactattatactggaagtggtttttgtgttataaaggtttaattttacataaggcagttacttaatgtgatttttaacccttaaaaaagtggagatgtatacatttgttaacaatgccatgaaagcattttctttctcctaaggaaaagtgaatttcttatcagaatatctggctggccctgtaatttaaattaaaataaaattttggagaaacagca

SEQ ID NO: 113033 - DNA, 1626 bp, Homo sapiens
  Payload ID: 2114
  Gene Symbol: CAB39
  Gene Name: calcium binding protein 39
  Uniprot ID: Q9Y376
  ENST ID: ENST00000409788
  CDS Start-End: 555-1580
agtcgggcgggcggggaagtgcgggccgggtcaactgtcaccggctgcacccgggcttcagcgcctcgctcccgcccctggtaaacttcctgttgtcgggaggcagataccagctttgtgaccaattcaggaaaatgcctaactgatttctggttaggaattgggcggtcggagcgttctggagttcaatggaaccaccccaagcgcagactgcgtgcaggcgccgtagtcggcccgcaccggagggattcaaaggtgaagcgggccccggtcccctcccccgaggagcttaggctctggtgtgagagataagacgagaacacaaataactgcgataccgggaaggaggtgataagtcctgtgaaagaacgacggagtgctagaacggcacccggaaaaaccgaaccgatcacttctgcctcgcagaaacctggaaggcttcctgggcgggggatgctgagcagagtcttgaaggcctgatgggatttaggagaggaggattgcagaagaggtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgtt

SEQ ID NO: 113034 - DNA, 1324 bp, Homo sapiens
  Payload ID: 2114
  Gene Symbol: CAB39
  Gene Name: calcium binding protein 39
  Uniprot ID: Q9Y376
  ENST ID: ENST00000410084
  CDS Start-End: 299-1324
agtcgggcgggcggggaagtgcgggccgggtcaactgtcaccggctgcacccgggcttcagcgcctcgctcccgcccctggtaaacttcctgttgtcgggaggcagataccagctttgtgaccaattcaggaaaatgcctaactgatttctggttaggaattgggcggtcggagcgttctggagttcaatggaaccaccccaagcgcagactgcgtgcaggcgccgtagtcggcccgcaccggagggattcaaaggtagcacaggcggagtgcagcggaggcccctgccgctgccgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggaacagcattatgatagatttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaa

SEQ ID NO: 113035 - DNA, 1619 bp, Homo sapiens
  Payload ID: 2114
  Gene Symbol: CAB39
  Gene Name: calcium binding protein 39
  ENST ID: ENST00000614925
  CDS Start-End: 5-1024
cgtcatgccgttcccgtttgggaagtctcacaaatctccagcagacattgtgaagaatctgaaggagagcatggctgttctggaaaagcaagacatttctgataaaaaagcagaaaaggctacagaagaagtttccaaaaatctggttgccatgaaagaaattctgtatggcacaaatgaaaaagagcctcagacagaagcagtagctcaacttgctcaagaactctataatagtgggctccttagcaccctggtagctgatttacagctcattgactttgagggcaaaaaagacgtggctcaaattttcaacaatattctcagaagacaaattggtacgagaactcctactgttgaatacatctgcacccaacagaatattttgttcatgttattgaaagggtatgaatctccagaaatagctctaaattgtggaataatgttaagagaatgcatcagacatgaaccacttgcaaaaatcattttgtggtcggaacagttttatgatttcttcagatatgtcgaaatgtcaacatttgacatagcttcagatgcatttgccacattcaaggatttacttacaagacataaattgctcagtgcagaatttttggttctcttatcttttttcagtgaatatgagaagttacttcattcagaaaattatgtgacaaaaagacagtcactgaagcttctcggtgaactactactagatagacacaacttcacaattatgacaaaatacatcagtaaacctgagaacctcaaattaatgatgaacctgctgcgagacaaaagtcgcaacatccagtttgaggcctttcacgtttttaaggtgtttgtagccaatcctaacaagacgcagcccatcctagacatcctcctcaagaaccaggccaaactcatagagttcctcagcaagtttcagaacgacaggacggaggatgagcagtttaacgacgagaagacctatttagttaaacagatcagggatttgaagagaccagctcagcaagaagcttaatctccaataaacatctatgttaaatccaaattcagcatttgctgttagctattcagcatcaggcactcttattgattcatgaggaacattactgctaatctgctgttaagtgaacggtttttcattttacccttttgtttttcagtccaggttggagatcgtagctgctgctgcttgcacactagggcacatgtgggctttctcttgatctttgtgtcatttcagaattcaaagactgtgctacgggagttctgaacatggctgggttcatgaaggcaaatgtatggatgagagtgtggtttaggaaagagggcactgatatcagattagacctatgtgtttgcacccatctttgttggcgatctgagtgcagtgtggcaagtgcacacctggcatccctgcgtcagatcgcgcaccttcaggtcgcgcaccttcgctgaaggaagatgacgcagagctttatctgaaatcagaggggagctatccaaaatgggagtttgggggcagctaaagttgacatgcgaataaattgatactgaaacttagcaacttcttaaaagtgtaaagaagcctcataagatcataaggaaaatgt

SEQ ID NO: 113036 - DNA, 3361 bp, Homo sapiens
  Payload ID: 2115
  Gene Symbol: CAB39L
  Gene Name: calcium binding protein 39-like
  Uniprot ID: Q9H9S4
  ENST ID: ENST00000347776
  CDS Start-End: 189-1202
ggatttcttgtagaagccagttaaaaggagaacctagtatcacactaggcttctgaaaacaccaatcaagagttgcttaatgcaggggtcccttacccctgggctgcagacctgtacctgtccatggcctgttaggaaccgggcagcacagtaggagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtacc

SEQ ID NO: 113037 - DNA, 3676 bp, Homo sapiens
  Payload ID: 2115
  Gene Symbol: CAB39L
  Gene Name: calcium binding protein 39-like
  Uniprot ID: Q9H9S4
  ENST ID: ENST00000355854
  CDS Start-End: 499-1512
gtgacgttacaggactgaggagggaggaagtaaaagggagctgtgactgtggtacgtatctgaaagcaagtgttagagagggagtggagaacgcataagcaagctggtttgaccagaaacagaactgcctgtgacagattaagagacaagcaaggcttggaatctgagagcaagcaaagagagtggaaatttacagctgccctatgtgagtgttcaagtgatcattttctggtaacgttttccagtggtaactgttactcttcaaaaagagggacagaaagtcaagacctaattgtggaaactcttttctctgccacgcttggtaataggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtaccacaca

SEQ ID NO: 113038 - DNA, 1627 bp, Homo sapiens
  Payload ID: 2115
  Gene Symbol: CAB39L
  Gene Name: calcium binding protein 39-like
  Uniprot ID: Q9H9S4
  ENST ID: ENST00000410043
  CDS Start-End: 452-1465
gagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaaggaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaa

SEQ ID NO: 113039 - DNA, 2416 bp, Homo sapiens
  Payload ID: 2115
  Gene Symbol: CAB39L
  Gene Name: calcium binding protein 39-like
  Uniprot ID: Q9H9S4
  ENST ID: ENST00000409308
  CDS Start-End: 387-1400
ccgcagtggcgcccgagcgcgccgcctcccgattgactgctagcgctctcggcttgtctcgcgcactgtagctgagccaatggagttactcgtagtcgagaggccggcatcactggagtggtggcgcagctgtttcctccggatatccatcaaatattgagaagaaagaatatcaggagcaaagtgttctaagttgctgttcagaacgtaaagatgcgaaccccaaatcagtggtttgttcattcttcatgcaagagcaatgcactaaaggagagaagcaagctgtggtgatcagtgactttggtgaaagctaagaaggttcaaacaaatttgcaaatgatatacaacttctaagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgta

SEQ ID NO: 113040 - DNA, 468 bp, Homo sapiens
  Payload ID: 2115
  Gene Symbol: CAB39L
  Gene Name: calcium binding protein 39-like
  ENST ID: ENST00000409082
  CDS Start-End: 189-468
ggatttcttgtagaagccagttaaaaggagaacctagtatcacactaggcttctgaaaacaccaatcaagagttgcttaatgcaggggtcccttacccctgggctgcagacctgtacctgtccatggcctgttaggaaccgggcagcacagtaggagcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgaggtaa

SEQ ID NO: 113041 - DNA, 1411 bp, Homo sapiens
  Payload ID: 2115
  Gene Symbol: CAB39L
  Gene Name: calcium binding protein 39-like
  ENST ID: ENST00000409130
  CDS Start-End: 145-726
gagtatatctaagtgtttcagaatacactcaaattccagaatacgtctgcaatagtgccaggcacatagtagatcttcagtggatattgaatgaatcgtgacaaatgatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacg

SEQ ID NO: 113042 - DNA, 633 bp, Homo sapiens
  Payload ID: 2115
  Gene Symbol: CAB39L
  Gene Name: calcium binding protein 39-like
  ENST ID: ENST00000413278
  CDS Start-End: 249-633
agcgttttgttagggaagaagtggagaacagatattggaaggcaattagctgtctctaatacattgataaaatatataactataactgcaaaatgctaataacccagcagaggagtagatttgggaacataagatgaaaaagtcaacaagtgcattgatcacaacatatggtaatgatagcgtgattgtgatgacctttgttttatacctccttttacattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgc

SEQ ID NO: 113043 - DNA, 727 bp, Homo sapiens
  Payload ID: 2115
  Gene Symbol: CAB39L
  Gene Name: calcium binding protein 39-like
  ENST ID: ENST00000457041
  CDS Start-End: 163-727
agagagggagtggagaacgcataagcaagctggtttgaccagaaacagaactgcctgtgacagattaagagacaagcaaggcttggaatctgagagcaagcaaagagagtggaaatttacagctgccctatcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaagg

SEQ ID NO: 113044 - DNA, 1035 bp, Homo sapiens
  Payload ID: 2115
  Gene Symbol: CAB39L
  Gene Name: calcium binding protein 39-like
  ENST ID: ENST00000425242
  CDS Start-End: 1-843
gcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaagatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtc

SEQ ID NO: 113045 - DNA, 3692 bp, Homo sapiens
  Payload ID: 2115
  Gene Symbol: CAB39L
  Gene Name: calcium binding protein 39-like
  Uniprot ID: Q9H9S4
  ENST ID: ENST00000610540
  CDS Start-End: 520-1533
ggatttcttgtagaagccagttaaaaggagaacctagtatcacactaggcttctgaaaacaccaatcaagagttgcttaatgcaggggtcccttacccctgggctgcagacctgtacctgtccatggcctgttaggaaccgggcagcacagtaggaggactgaggagggaggaagtaaaagggagctgtgactgtggtacgtatctgaaagcaagtgttagagagggagtggagaacgcataagcaagctggtttgaccagaaacagaactgcctgtgacagattaagagacaagcaaggcttggaatctgagagcaagcaaagagagtggaaatttacagctgccctatgaggcaacctctattaaatggacgataaaggctacttcatctaaagtgctttgagctcaagaaagagctgtcttcagcacctcaccatgtgtctacattttgttgcttagaaaagcctaggcatttctgtaacatttgcattccatattggaagaagagatttctacacatgaaaaaaatgcctttgtttagtaaatcacacaaaaatccagcagaaattgtgaaaatcctgaaagacaatttggccattttggaaaagcaagacaaaaagacagacaaggcttcagaagaagtgtctaaatcactgcaagcaatgaaagaaattctgtgtggtacaaacgagaaagaacccccaacagaagcagtggctcagctagcacaagaactctacagcagtggcctgctagtgacactgatagctgacctgcagctgatagactttgagggaaaaaaagatgtgacccagatatttaacaacatcttgagaagacagataggcactcggagtcctactgtggagtatattagtgctcatcctcatatcctgtttatgctcctcaaaggatatgaagccccacagattgccttacgttgtgggattatgctgagagaatgtattcgacatgaaccacttgccaaaatcatcctcttttctaatcaattcagagatttctttaagtacgtggagttgtcaacatttgatattgcttcagatgcctttgctactttcaaggatttactaaccagacataaagtgttggtagcagacttcttagaacaaaattacgacactatttttgaagactatgagaaattgcttcagtctgagaattatgttactaagagacagtctttaaagctgctaggggagctgatcctggaccgtcacaactttgccatcatgacaaagtatatcagcaagccggagaacctgaaactcatgatgaacctccttcgggataaaagtcccaacatccagtttgaagcctttcatgtttttaaggtgtttgtggccagtcctcacaaaacacagcctattgtggagatcctgttaaaaaatcagcccaaactcattgagtttctgagcagcttccaaaaagaaaggacggatgatgagcagttcgctgacgagaagaactacttgattaaacagatccgagacttgaagaaaacggccccttgaagagctccccggcccctgtcacagtcagtcgtctcatttgtccagtttgtacagtgtgtcatttcagaaagtcatcattcttgggaagactttggaggtgcctattttttctgctgtaattgttctgggtagatggagtataaacatttgaatggaaaaaaattaacctagaataatatattcattttagtcaagtctgtgattatttatgtgaaatgagaaccattgtatcagatgttgataaaagcaattttaacttgcagatgtgagcccctgggcacaatgagccgctaaatgggagctcaattgacaggcatcaccaagtcttcaaggaggactgagttctcaggggagaactgggaatggggccagggtgcaaaaatgctttgcccatctgtaggtagacacacagatcgctcagggcactgagagatcccagaaggtaacgttaatgttttcagtcattgtgtgtcctttgttgctgccaatgtctttggactgtaatcagtgcatccacacctcccaggatccagtgctccctctcagctcagtctcccctctctccctgtcctgcattccatcccagctcctcagcatggcctcagtgggcgcacccatgcctcccgcagtccaggtgagcaggggagcaactgagcaggaagaggatggatcaacaagggtcacggggaataggggacccacggggtgtgacctgcttgctagagaactgtgaacatgtggctctggatagagtgactgctgctccatattagcttccagagggtgagtgagggacagaatatttccttcataatggtcatgggtgaatgctttctgctgtaagtgtcttttagagtaggaatcagcatagtgggatgcccagcaggcacaaaccatgggtccagggagtctcagcggggaacttctatcagtatcaataaccattggaaggagaaatgattcatgtgtgaaaaaattctcagatccatcaataaatttttttcagagccattgtatcagatgttgataaaagcaatttttttctaataagctgtcattctataattgcccatcacagtctttagtgaacacatagaaagcctatacagttttggtcctgaatagtctcttgtgactaggatgattgaggtgttaattcctcttccttataaaaaggcttggaatcaaaaatattttaaaaggccgtggtttcgtttcagacatcaaccatctaaaacgggattttaaagcgatattttacaagaatgaaaggcacaattgttgatctgtattttttacacttcagtttctaaatcatgaatcgttgccttccacaggaaccctcccttatacattacttgagtgttgtgtagtttttcttcagccaggtatttctctgcctagagaggggaagagaaatgtgttctccaggactgatcccctttgtagattttgtacctgaagagttacctggcagggcaccacccttggctaggcccaggtgtgtgtttctttcttgcctggcatggaccccgaggcaggtgatgtggggcctggcgcacctccccgctttggcagctgtggcctccctggccagtgcccttgcaggaggccggccggcagcctgatgacccgtactctttagtcactgacgtcagattatttttataacgttccctgacagttcagagtcccttcgaattgcacttttctggtttcgcttatttaattaaaagagatgagtgtaagtataaaaaatgaaggtgaaataaccattggaattgtatttggttacttaatactgttccacaacatcttgggacgtctgttttcctttggagagtgaggccttgttattattcttttctgataaagaaaacattttatttcctttgggcttgcattagctctttcctagcaacccattatcccagctcagtacctttcaaacagaaaactagagtctggggttttgttgtgatctgaatttgtaagttattaatgtgaaagggggagcaggaagctccccctttgcacaaagggggatttgtttgcacaaagttcactgtaaatactgtgagaattgaattctgaaaaggtcatatttagtgatttcaaaagcacacatttaaatgaagactgactaaataaaaggtacc

SEQ ID NO: 113046 - DNA, 2559 bp, Homo sapiens
  Payload ID: 2116
  Gene Symbol: CABP4
  Gene Name: calcium binding protein 4
  Uniprot ID: P57796
  ENST ID: ENST00000325656
  CDS Start-End: 78-905
cataagcagctttatgggtcctgaaagccaagggtgcccaggggtgtggtgtctctgagccctgttatccctcccccatgaccacagagcaggcaagggggcagcagggcccaaatctggccattggccgtcagaagccccctgcgggggttgtgactcccaagagtgatgcagaggagcccccgttgaccaggaagaggagcaagaaggagagggggctccgagggtctcgaaagcgcactggcagctctggggagcagacaggccccgaggccccggggagcagcaataaccctcccagcactggagaggggccggcgggcgcaccccctgcatcccctgggccggcctcttctcgccagtcccaccgacatcgtcctgactccctgcacgacgctgctcagaggacatacgggcccctgctcaatcgagtcttcgggaaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggaggtctcgcagcacatcaagatgcgcatgggcggccgtgtggactttgaggagtttgtagaactgataggcccaaagctgagggaggagacggcgcacatgctgggggtgcgagagctgcgcatcgccttccgagagtttgacagggacagggatggacgaattacggtggcggagctgcgggaggcggtaccggctctgctcggggagccgctggcgggtcctgagctggacgagatgctccgagaagtggacctcaatggggatggcaccgtagactttgacgagtttgtgatgatgctctcccgccactgaggctccaggagggaatatctgttgcccctgcggccccagacaccagccagacccaggctgcaggcctcccccaggagcctccaggatggagatggagacccagcagcccccagactacttctatccctgaaaacacctggcctcaatgttggcttgttatgttacctgcccaccctcatccttacctcctcctactcaagctgcctggagaagacctgctctcagctgcccaccgttcctcagtgtgagcaagatttgggtctctccagacctctgggaggtagggagttccctggcactggcagcattcagtggggaccccccagtggcatgatgaatggagaggatggctggaccccttccactacttatgtttataattttttttttttttaatgaacttgagccgggtgcagtggctcacacctgtaagcccagctgtcagggggcagaagcgggaggatagcttgagcccaggagtgcaagacctgcctgggcaatatactgagaccccattctccacaaaaaggaaaaataaaagacaaaaaaacaaacaaaaaaccaaaaaacccaagtgtaaaaaaagtgagcttgaaagaaagaaagggatggctccatgtatcaaagacaaagaaatcaaagctggggttgtaagagggagctgacgctgtgggggtttcagatctggatggaggcttggccgcctggactcctacaaccatgagtgacagaagaaccatatgagtctggggagcaagaaacaaaccccccggatatattccagggtctccaaaggctaagatattaatctgtctgcactgaccagtcatagaaagtggcaaggatacagatgttcagggcccagagtggaaacagctgccctaaagagcctggaactccagggcctgcccttcaagcaggcgtgtagtctctctccagggtgtgaaaaactggaaaaaaaccctgccgctcccaaaggggaacttgtgataaaaattacagattattgggctgggagtggtggctcacgcctgtaatcccagcactttgggaggctgaggcgggtgaattacctgaggtcaggagtttgaggccagcctgaccaacatggtgaaaccccatctctactaaaaatacaaaaattaactgggcgaggtagcatgcacctgtaatctcagctactcggaggttgaggcaggagaatcgcttgagcccgggaggtggagctgcagtgagctgagatcacaccattgcaccccagcctgagcaacagatcgagactccgtctcaaaaacaaaacaaaaaaaccatactgattataaaagtaaagaaaccaccatgaaggagacgagacagagacaaaaacaagaggactggcatctcagtgtacataatacagccgcctaagagaccacaagatacatgcaaataaaagacggctaaaaggggaagagagatcaacatgcagtaacaggatagtatgaagagagaaccggaagatttaaaaagtaacccaacaggccaggcgcatggctcatgcctggaatcccagcactttgggaggccaaggtgggtgggttgcttgagctcaggaattcgagaccagcctgggcaacatggtgaaaccctgtctctactaaaaatacaaaaatta

SEQ ID NO: 113047 - DNA, 1426 bp, Homo sapiens
  Payload ID: 2116
  Gene Symbol: CABP4
  Gene Name: calcium binding protein 4
  Uniprot ID: P57796
  ENST ID: ENST00000438189
  CDS Start-End: 345-857
aggcagctgtccccagcggccagtgtcccccatgccggatctctaggatctggaaggccgctgctgccaggaacaagaagtcagagagggccaggctgagcaggagcagcgccagacgcgtgccagctccatgccgggcctgggagccggccagccacgccatcaacccattggctggcagcccaaggagcagcagggccaccaggaagaccgtgtcccagccaccttggggtcccaccgacatcgtcctgactccctgcacgacgctgctcagaggacatacgggcccctgctcaatcgagtcttcgggaaggccaacatgagcaggggatgaaggaggaaggatgacagagccgtggctggccctggggacatcctggactctccccctgcaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggaggtctcgcagcacatcaagatgcgcatgggcggccgtgtggactttgaggagtttgtagaactgataggcccaaagctgagggaggagacggcgcacatgctgggggtgcgagagctgcgcatcgccttccgagagtttgacagggacagggatggacgaattacggtggcggagctgcgggaggcggtaccggctctgctcggggagccgctggcgggtcctgagctggacgagatgctccgagaagtggacctcaatggggatggcaccgtagactttgacgagtttgtgatgatgctctcccgccactgaggctccaggagggaatatctgttgcccctgcggccccagacaccagccagacccaggctgcaggcctcccccaggagcctccaggatggagatggagacccagcagcccccagactacttctatccctgaaaacacctggcctcaatgttggcttgttatgttacctgcccaccctcatccttacctcctcctactcaagctgcctggagaagacctgctctcagctgcccaccgttcctcagtgtgagcaagatttgggtctctccagacctctgggaggtagggagttccctggcactggcagcattcagtggggaccccccagtggcatgatgaatggagaggatggctggaccccttccactacttatgtttataattttttttttttttaatgaacttgagccgggtgcagtggctcacacctgtaagcccagctgtcagggggcagaagcgggaggatagcttgagcccaggagtgcaagacctgcctgggcaatatactgagaccccattctccacaaaaaggaaaaataaaagacaaaaaaacaaacaaaaaaccaaaaaa

SEQ ID NO: 113048 - DNA, 682 bp, Homo sapiens
  Payload ID: 2116
  Gene Symbol: CABP4
  Gene Name: calcium binding protein 4
  ENST ID: ENST00000545777
  CDS Start-End: 22-408
gagccctgttatccctcccccatgaccacagagcaggcaagggggcagcagggcccaaatctggccattggccgtcagaagccccctgcgggggttgtgactcccaagagtgatgcagaggagcccccgttgaccaggaagaggagcaagaaggagagggggctccgagggtctcgaaagcgcactggcagctctggggagcagacaggccccgaggccccggggagcagcaataaccctcccagcactggagaggggccggcgggcgcaccccctgcatcccctgggccggcctcttctcgccagtcccaccgacatcgtcctgactccctgcacgacgctgctcagaggacatacgggcccctgctcaatcgagtcttcgggaaggggatgaaggaggaaggatgacagagccgtggctggccctggggacatcctggactctccccctgcaggaccgcgaactgggccccgaggagctagacgagcttcaggccgccttcgaggagtttgacactgaccgtgacggctacatcagccaccgggagctgggtgactgcatgcggaccctgggctacatgcccaccgagatggagctcctggagtgggcggccgtgtggactttgaggagtttgtagaactgataggcccaaagctgagggaggagacggcgcacatgctg

SEQ ID NO: 113049 - DNA, 1257 bp, Homo sapiens
  Payload ID: 2117
  Gene Symbol: CABP5
  Gene Name: calcium binding protein 5
  Uniprot ID: Q9NP86
  ENST ID: ENST00000293255
  CDS Start-End: 132-653
gagaagccaagagaggcaggaagaggtggcaaaggagtgctggagaagataaggaggctgagctccgacagggagcagggaggaggggccatcttgagactggtgccctgcgagctccaccccacccctccatgcagttccccatgggccccgcctgcatcttcttgaggaaaggcattgctgagaaacagcgggaaagaccactgggacaagatgagattgaagagctgcgggaagcatttcttgagttcgataaggaccgagatgggttcatctcttgtaaggatctggggaatctcatgaggacgatgggttacatgcccacggagatggaactgattgagctcggccagcaaatccgcatgaacctgggtggccgtgtagactttgatgactttgtggagctgatgacccccaaattgcttgcagaaacagctgggatgatcggtgtccaggagatgcgggatgccttcaaggagtttgacacgaatggagatggggagatcaccctggtggagctacagcaggccatgcagagactcctgggggagcggctcaccccccgggagatctctgaggttgtccgggaggctgatgttaatggagacggcacagttgactttgaagagtttgtgaagatgatgtctcgctgaggaggtcctggaagctccagaccctctccacctggtcaacatggagcaagcgcttgtggagaaccaaagcccaaaagccccagatccccttaaagcagagagggagggcaggcgggagggagggcattggcatgcggcgctgtgcatggggtgagacccagagcggtatctttgccaggatgggggcgtctgcagaactagattaagaaggaagagtctgtggatggaaataggaagcgtgggagggtccagttgccacccccaaaaattccaatgattcttgacatcttttcacttcacgtagtcctaagtccctgtgacctgccagagtctcttccccagcttccccttgggtgaaaatagtctcttctcctgttgggtatcaaaaggttcagaacgtagtctctactcttcccctgcctgcatcaactgttgcaaatcccgtttctctctcccggtaaggggacaaattatactttattcaggtgatggttacatgaacagcccagacttcaccactacgcaatatatccatgtaacaaaaccgcacttgtactccctaaatctatagaaatacaaaatgaaataaaaaggatgcaaatca

SEQ ID NO: 113050 - DNA, 3259 bp, Homo sapiens
  Payload ID: 2118
  Gene Symbol: CABP7
  Gene Name: calcium binding protein 7
  Uniprot ID: Q86V35
  ENST ID: ENST00000216144
  CDS Start-End: 342-989
agcgggcggcgagcagcgcggagcgcgcggggcaccgaggagcgggcgcggcgggcaccgcgcgaggcagccggagctctcggaaaggccagagcggcgccgcccccgctgcccctgcggggccccggctgggagcccgacgagggagcgggcggcatggcccggcggcccggggcgcgggggcgctaggcccccggaggggcgtccccagcctcgccgctgccgccgccgccctccgcagccgcgcgccccgcccgctccagccgcccccggggccgccaccggcccatgagccccggcctcaaagtttgcggcgggcgggcgggcgcggagcctccaagatgccgttccacccggtgacggcggcgttgatgtaccggggcatctacaccgtgcccaacctgctgtcggagcagcgcccggtggacatcccggaggacgagctggaggagatccgagaggccttcaaggtgtttgaccgtgacggcaatggcttcatctccaagcaggagctgggcacagccatgcgctcactgggttacatgcccaacgaggtggagctggaggtcatcatccagcggctggacatggatggtgatggtcaagtggactttgaggagtttgtgacccttctgggacccaaactctccacctcagggatcccagagaagttccatggcaccgactttgatactgtcttctggaagtgcgacatgcagaagctgacggtggatgagctgaagcggctgctctacgacaccttctgcgagcacctgtccatgaaggacatagagaacatcatcatgacggaggaggagagccacctgggcacagccgaggagtgtcccgtggatgtggagacctgctccaaccagcagatccgccagacttgcgtgcgcaagagtctcatctgcgccttcgccatcgccttcatcatcagtgtcatgctcattgcggccaaccaggtgctgcgcagtggcatgaagtagacgccacctggatgccccatccaccgcatgcggtgcccgtggcccgccccacaccaccgccgcctgcagacctctcccttggccggctccctgggccgccatctgcgtgtacttcagggcctgggtatccagcgagccctccccacccacccacggtcctcacctggagctgtggcctggctgtggagggccgggtggtggctctgaggatggtccccagccccaccctgtccccaccctggcctgtaaggagcactcactcttcctaccatccaggggctcctgggaaattaaggagggatttgcacaggaacccccaggacccagtcgctgctgtggtcccttgggcaggagcgggcaccctgtgccttgagacagcagcctatctggggccacacagccaacccagccctggtccctgaggtctgcccagggcacagggcacaggcagggacagaaagccttctcctgggggagggtgggaagccagggtgtcctgggccttgctgcctggcatagcctgaggaggcccctggtcttctccttgggccccttcctctgaccctcgttggaccccaacccagacccccttttctccatgtacctgctgggccagcccatttcacaggtgaggaacccgaggctcagggccccgagacttggcctcagttcttccttccacagggattttcaggaaaggcagaagctcgtggaggatgggcatctgaggtggccctgcagccccccaccttctggccctcccaccagaggcccagctaccaaggccacattgtccaccaccccagcctagagcctagaactgtagtccagctgaggaaggaggcagagctggggcctgaaggctctgagcagcctccagccagggggctcctccagggctgaactttgggagggcccctgtactacctcctgggccaagaaactggcacagccccacactgtcagtgccaagaggctgcgccaggccactctctcagcccagggcctgccctcctgtcctcccacttctctacgccctcaaggttggagaccccgctcccatgccccagctgtgccatcccaaatacttgggcagcagctcagcatgggcagacatgggggctgtggattcttccagggcggggatggcagatggagcccttgggctccttgggcctagagccacttcttaccaggcaacgggcacagccaccctggcacaccctctgcctggccgtgctgaacctctgctggtcccaagggagaagggagtgagcgtgggtcacctggggaaaatctcatctgattccctccttgcccgacctctgctaggggctggagaacagagctcagagcacccagtgtagggaaacacagccagaccactgtggtgacagactttctttataaacatttggaagttttctcccccatcttcttaagaagcaggggggcaggtggaggagagtgaggggagagctgcccggtgcagacccaggacgagggctgcacttggtgtggccgtgtcctgagcctcagtgaggctgggcagatggtctcggagcctccatggggcgtagcaggaaccgggcttggcttcctattgtgactgatgagaaaagtgaccacgtgggggtcagtcgggggcaaggggctcagccccactggactctgggctgcagaggccaccccccaggtgggggtgcccgcagggatggaggcagctcctgaactggtggccagcccacggggtactggaagacagtggttctgatgggttcagccctagagagagagagagaagcggggagaataagagtgcactacagcccaggcttatgccacccccagcccacctgcctcaccaccctggctgtggggagggtcagctgcctgcatgacttttctggaaggcagagcctcgaaaataggcagaccgtttgagccagcgacctcacctctaggaactgagcccaaggaaatagcggggttgcaggcagacattgagctgcgagacaatgggaataaccttcgtgtccacctgtgggggactgattcaatacatatgcacgtccacagcagagaatgccatgcggcctgtgtaagaattaaggcagatttatatgcactgatgaggaaagacatactgtgtgatagggagaaaaagcagcttataaaataatgtatatagcatgatactatttttgtttaaaaatatataaaatatataaatgcataaaaaaatcctggaagacacagcaaaatgttaa

SEQ ID NO: 113051 - DNA, 1109 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000327201
  CDS Start-End: 183-1028
taaaaacgctcgcaagcgccaagtctcctcaggagccgccggcaagggggcaacgaggaagctcttaagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagc

SEQ ID NO: 113052 - DNA, 2252 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000399481
  CDS Start-End: 127-1554
atgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcat

SEQ ID NO: 113053 - DNA, 1414 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000399496
  CDS Start-End: 188-1327
ggccccgcctccttgagtggtgcggagctttgtgatgcggagcttcgtgatgcacgccccgatgcctgcggggctataaaaacgctcgcaagcgccaagtctcctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcatacaa

SEQ ID NO: 113054 - DNA, 1272 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000399499
  CDS Start-End: 61-1200
cctatggctccgaagtccccgctggcatcctgaaagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaactt

SEQ ID NO: 113055 - DNA, 824 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000415309
  CDS Start-End: 76-741
cgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcat

SEQ ID NO: 113056 - DNA, 1664 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000486759
  CDS Start-End: 82-1563
aggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagatccagaaatgacgctgtctgggtcaacatttcagggaggagtctgccaccagtgtaatgtatcaataaacttcatgcaagcata

SEQ ID NO: 113057 - DNA, 1792 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000463087
  CDS Start-End: 86-1567
cctcaggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagcata

SEQ ID NO: 113058 - DNA, 535 bp, Homo sapiens
  Payload ID: 2119
  Gene Symbol: CABYR
  Gene Name: calcium binding tyrosine-(Y)-phosphorylation regulated
  ENST ID: ENST00000584752
  CDS Start-End: 82-303
aggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagatggtgcaactaatgtttgttgaatgaagaaagaatggatggaagggcaaggaggaagaggggagaaactaaaccacctactttatatagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttc

SEQ ID NO: 113059 - DNA, 871 bp, Homo sapiens
  Payload ID: 2119
  Gene Symbol: CABYR
  Gene Name: calcium binding tyrosine-(Y)-phosphorylation regulated
  ENST ID: ENST00000581872
  CDS Start-End: 82-303
aggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagatggtgcaactaatgtttgttgaatgaagaaagaatggatggaagggcaaggaggaagaggggagaaactaaaccacctactttatagtctctgtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaa

SEQ ID NO: 113060 - DNA, 451 bp, Homo sapiens
  Payload ID: 2119
  Gene Symbol: CABYR
  Gene Name: calcium binding tyrosine-(Y)-phosphorylation regulated
  ENST ID: ENST00000579102
  CDS Start-End: 199-451
ggtgataggagagatctgggaagaattattaagctgtcgcttttaaataaccctaatagtgtttgtgacaattttacccgttgacttttctcagcttgcttaggacagttctttgtggggaactgaactgtaggacgtttagcgtccctggccccacacgttcccaaagtcgggttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaag

SEQ ID NO: 113061 - DNA, 634 bp, Homo sapiens
  Payload ID: 2119
  Gene Symbol: CABYR
  Gene Name: calcium binding tyrosine-(Y)-phosphorylation regulated
  ENST ID: ENST00000581397
  CDS Start-End: 47-634
taagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttagcaatggcaacaagtgaacgaggacaaccaccaccatgttctaacatgtggaccctttattgtctaactgataagaatcaacaaggtcacccatcaccgcca

SEQ ID NO: 113062 - DNA, 1090 bp, Homo sapiens
  Payload ID: 2119
  Gene Symbol: CABYR
  Gene Name: calcium binding tyrosine-(Y)-phosphorylation regulated
  ENST ID: ENST00000582229
  CDS Start-End: 1-880
tatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaat

SEQ ID NO: 113063 - DNA, 605 bp, Homo sapiens
  Payload ID: 2119
  Gene Symbol: CABYR
  Gene Name: calcium binding tyrosine-(Y)-phosphorylation regulated
  ENST ID: ENST00000585037
  CDS Start-End: 467-605
aggagccgccggcaagggggcaacgaggaagctcttaagagcgcggccggaaagcagacggactctagctgtgtcacccaggctggagtgcagtggcgcgatctcggctgtcagctccgcctcccggattcacgccattctcctgcctcagcctcccgagtagctgggactacaggcacccgccaccacgcccggctgattttttgttttagtagagacggggtttcaccgtgttagccaggatggtctccatctcctgacctcgcctcgtgatccgcccgactcggcctcccaaagtgctgggattacaggcgtgagccaccgcgcccggcctctgggagccactttcaaaacggtctatctactcactttggagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccag

SEQ ID NO: 113064 - DNA, 596 bp, Homo sapiens
  Payload ID: 2119
  Gene Symbol: CABYR
  Gene Name: calcium binding tyrosine-(Y)-phosphorylation regulated
  ENST ID: ENST00000577705
  CDS Start-End: 487-596
ggagccgccggcaagggggcaacgaggaagctcttaagagcgcggccggaaagcagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagaatgaagccgcggaccctcacggtgagttacagctcctaaggtggcacgtctggagtttgctccttctgacgttcggatgtgttcggagtttcttccttctggtgggttcgtggtctcgctggctcaggagtgaagctgcagaccttcatgtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacgga

SEQ ID NO: 113065 - DNA, 443 bp, Homo sapiens
  Payload ID: 2119
  Gene Symbol: CABYR
  Gene Name: calcium binding tyrosine-(Y)-phosphorylation regulated
  ENST ID: ENST00000579956
  CDS Start-End: 82-303
aggagccgccggcaagggggcaacgaggaagctcttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagatggtgcaactaatgtttgttgaatgaagaaagaatggatggaagggcaaggaggaagaggggagaaactaaaccacctactttatagtctctggtaccatgaacctgtgagggagacacttttaattaaaagagcaagtggtcctttccagagttgcctaag

SEQ ID NO: 113066 - DNA, 2226 bp, Homo sapiens
  Payload ID: 2119
  Gene Symbol: CABYR
  Gene Name: calcium binding tyrosine-(Y)-phosphorylation regulated
  Uniprot ID: O75952
  ENST ID: ENST00000621648
  CDS Start-End: 49-1530
cttaagagcgcggccggaaagcagttgagttacagacatcctgccaaaatgatttcttcaaagcccagacttgtcgtaccctatggcctcaagactctgctcgagggaattagcagagctgttctcaaaaccaacccatcaaacatcaaccagtttgcagcagcttattttcaagaacttactatgtatagagggaatactactatggatataaaagatctggttaaacaatttcatcagattaaagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcacttttccaacttatgtgatgggcgacaccaagaagaccagtgccccaccttttatcttagtaggctcaaatgttcaggaagcacagggatggaaacctcttcctggacatgctgtcgtttcacagtcagatgtcttgagatatgttgcaatgcaagtgcccattgctgttcctgcagatgagaaataccagaaacataccctaagtccccagaatgctaatcctccaagtggacaagatgtccccaggccaaaaagccctgttttcctttctgttgctttcccagtagaagatgtagctaaaaaaagttcaggatctggtgacaaatgtgctccctttggaagttacggtattgctggggaggtaaccgtgactactgctcacaaacgtcgcaaagcagaaactgaaaactgatccagaaatgacgctgtctgggtcaacatttcagggaggagtctgccaccagtgtaatgtatcaataaacttcatgcaagc

SEQ ID NO: 113067 - DNA, 1622 bp, Homo sapiens
  Payload ID: 2119
  Gene Symbol: CABYR
  Gene Name: calcium binding tyrosine-(Y)-phosphorylation regulated
  ENST ID: ENST00000627314
  CDS Start-End: 228-1415
gtgatgcggagcttcgtgatgcacgccccgatgcctgcggggctataaaaacgctcgcaagcgccaagtctcctcaggagccgccggcaagggggcaacgaggaagctcttaagagcgcggccggaaagcagtagagaaatggtcagaaggaacgacaccacagaagaaattagaatgtttaaaagaaccaggaaaaacatctgtagaatctaaagtacctacccagatggaaaaatctacagacacagacgaggacaatgtaaccagaacagaatatagtgacaaaaccacccagtttccatcagtttatgctgtgccaggcactgagcaaacggaagcagttggtggtctttcttccaaaccagccacccctaagactactaccccaccctcatcaccacctccaacagctgtctcaccagagtttgcctacgtcccagctgacccagctcagcttgctgctcagatgttaggtaaagtttcatctattcattctgatcaatctgatgtgttaatggtggatgtggcaaccagtatgcctgttgttatcaaggaggtgccaagctcagaggctgctgaagatgtcatggtggctgctcctcttgtgtgttctggaaaggtgctagaagtgcaggttgtgaaccaaacatctgtccatgtagatttgggttctcaacctaaagaaaatgaggctgaaccatcaacggcttcctcagtccccttgcaggatgaacaagaacctcctgcttatgatcaagctcctgaggtcactttgcaggctgatattgaggttatgtcaactgttcatatatcatctgtctataacgatgtgcctgtgactgaaggagttgtttatatcgagcaactgccagaacaaatagttatcccttttactgatcaagttgcttgtcttaaagaaaatgagcagtcaaaagaaaatgagcagtcaccacgagttagtcccaaatctgtagtagaaaagaccacctctggcatgtctaaaaaatctgtagagtctgtaaaacttgcacagttggaggagaatgcaaaatattcctcagtatatatggaggcagaagcaacagctctgctctctgacacatctttgaaaggtcagcctgaggtacctgcacaactcctggatgcagaaggtgctatcaaaataggctctgaaaaatctctgcaccttgaagtggagatcacttcaatagtctctgacaatactgggcaggaggagtctggggaaaactctgtaccccaggagatggaaggcaaacctgtgctctctggggaagctgcagaagcagtgcactcaggtacatctgtaaagtcatctagtggccccttccctcctgctccagaaggccttactgcaccagaaattgaaccagaaggggaatcaacagctgaataaggtttgatgaagccagcaatggcaacaagtgaacgaggacaaccaccaccatgttctaacatgtggaccctttattgtctaactgataagaatcaacaaggtcacccatcaccgccacctgcacctgggccttttccccaagcaaccctctatttacctaatcctaaggatccacagtttcagcagcatccaccaaaagtcactttt

SEQ ID NO: 113068 - DNA, 2688 bp, Homo sapiens
  Payload ID: 2120
  Gene Symbol: CACFD1
  Gene Name: calcium channel flower domain containing 1
  Uniprot ID: Q9UGQ2
  ENST ID: ENST00000291722
  CDS Start-End: 101-493
gctaatatgctccctctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatgatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgccttggtgcctgtgtgtgagtgtggaagccaggcaggagccgctggcccaggaaataactac

SEQ ID NO: 113069 - DNA, 2794 bp, Homo sapiens
  Payload ID: 2120
  Gene Symbol: CACFD1
  Gene Name: calcium channel flower domain containing 1
  Uniprot ID: Q9UGQ2
  ENST ID: ENST00000316948
  CDS Start-End: 81-599
acaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaagggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgccttggtgcctgtgtgtgagtgtggaagccaggcaggagccgctggcccaggaaataactac

SEQ ID NO: 113070 - DNA, 356 bp, Homo sapiens
  Payload ID: 2120
  Gene Symbol: CACFD1
  Gene Name: calcium channel flower domain containing 1
  ENST ID: ENST00000444798
  CDS Start-End: 13-356
gctggaggccaaatgctgactgcagcaggaagcacagccgagctgtcagcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaa

SEQ ID NO: 113071 - DNA, 2880 bp, Homo sapiens
  Payload ID: 2120
  Gene Symbol: CACFD1
  Gene Name: calcium channel flower domain containing 1
  Uniprot ID: Q9UGQ2
  ENST ID: ENST00000540581
  CDS Start-End: 103-804
atgctaatatgctccctctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatcatgaatgccttcatcttgttgctgtgtgaggcgcccttctgctgccagttcatcgagtttgcaaacacagtggcggagaaggtggaccggctgcgctcctggcagaaggctgtcttctactgcgggatggcggtcgttcccatcgtcatcagcctgaccctgaccacgctgctgggcaacgccatcgcctttgctacgggggtgctgtacggactctctgctctgggcaaaaaagcccagactgaggctggttccttcgcagcccagcatcccagggagcctgggccattctcagaggggacaagacaggcctttgccaccccagcagttgtctctggggaaatcagaatgcctgcaggggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgc

SEQ ID NO: 113072 - DNA, 2754 bp, Homo sapiens
  Payload ID: 2120
  Gene Symbol: CACFD1
  Gene Name: calcium channel flower domain containing 1
  Uniprot ID: Q9UGQ2
  ENST ID: ENST00000542192
  CDS Start-End: 103-678
atgctaatatgctccctctcccacaaggcagcgcgccggctcggacgcggccggctaccgagccctttgtgagggctgtgagctgcgcctgacggtggcaccatgagcagctcaggtggggcgcccggggcgtccgccagctctgcgccgcccgcgcaggaagagggcatgacgtggtggtaccgctggctgtgtcgcctgtctggggtgctgggggcagtctcttgcgcgatctctggcctcttcaactgcatcaccatccaccctctgaacattgcggccggcgtgtggatgatgatggcggtcgttcccatcgtcatcagcctgaccctgaccacgctgctgggcaacgccatcgcctttgctacgggggtgctgtacggactctctgctctgggcaaaaaagcccagactgaggctggttccttcgcagcccagcatcccagggagcctgggccattctcagaggggacaagacaggcctttgccaccccagcagttgtctctggggaaatcagaatgcctgcaggggcgatgcgatctcctatgccaggatccagcagcagaggcagcaggcggatgaggagaagctcgcggagaccctggagggggagctgtgaagggctgggcgcccctccctccctgtcccctcttctggctctgtgtgggtccaagtgaggcctggactgtccacgctgaggcacagcctggagaggggcctttgcacgtgtccctacacctggagtcctctgctcctttctccagactggcttaagccaggagccactggctgctggtgtgagggtctgggctgctggacttgaggcagagcctgcagcagctgtgtggacactacccagccctactcctctgctgggtgggtctgcagatctcacaccacagacagggctgcctgtgacctgctgtgacctgggagcagcttcccctggagatgctggtcctggcttgaggggaggggcaagtgggaccctgccacctgggcactgagcagagggacctcccccagctctcttagcaggtggagccccagggcctgggacagcctgccgctgccagcaacctcccactgctgcctagggtgcagcgcccactgtcaccctgccttctgaagaagcccacagggctcctaaggtgcaccccggtacctggaactgcagccttggcagtgactggacagctgggtgggggatgctccctgctggccctgggaaccttggacaggccacctcaaggcccctcggctgcccctcctccctgggcctgctggggcccctaggttctgcccatcaccccccgcccctgctggccttggtgctaaggaagtggggagagcaggctctccctggcaccgagggtgcccaccctctccctggtgtggccccgtcaacatcagccacagcccagccccattagtgggttagtgggtctgacctcagccccactcaggtgctcctgctggcctgcccaagccctgccctcagggagcttctgccttttaagaactgggcagaggccacagtcacctccccacacagagctgtccccactgccctgggtgccaggctgtccggagccaggcctacccagggaggatgcagagagctggtgcccaggatgtgcacccccatattccctctgccctgtggcctcagcccgctggcctctctgaccgtgaggctggctctcagccatcgggcaggtgcctggtcgggcctggcttagcccaggtggggtttggcagaagcgggcgggtgtggaagatattccatctggggccaaccccaggctgggcctgcgctgagcttctggagcgcaggtactgggtcttgctaagtgaactgtttcccaggaacacctctcgggcccatctgcgtctgaggctgggagtggcatctgaggccgggagtggcatctgaggccaggagtggcaggctggtgggctgggcgtggggttttctgggccctgcccagtactgccctggggacttggtgggctcctgggtcagcagcatcccacccctgggagtctggccagctgagccccagggtggcaggggcattatagcctggtggacatgtgccttcagggttcctccggggccaccttcctcaggccagtgctgggttcaaagggctgtgtgtgtgtgtgtgtgtgtgtgtgtgtgtgtgtgtatgtatatgtgtgtgggtgcacacatctgtcccatgtatgcagtgagacctgtctacctcccacaaggagcaagggctctgcccgccctctgctcattcctacccaggtagtgggaccccgggcccccttctgcctggcttgcctgcttctgccctttccagaggggtctcactgacagccagagacagcaggagaagggttggctgtggatcaaggaaggctgcccctgtaccctgtggggaaatggtgggtgcatggctggatgcagaggtggaaggccctgggccacaggcgagagtgggcgtgtcacctgtcccaggttcccagcaagtctgcagctgtgcagtcctggggtccctgaccctgtcgcccagggggcgtgctgtccagcaggggccctgccttgcaaggaacgtctcttccggcggctgggccgctcctgcctggtctgggctgtgtgtggcgccctttcctccttgtttgttcctctgtgttctgtgtgcgtcttaagcaataaagcgtggccgtggctcgcgtgcctgccctctgctcccttctgc

SEQ ID NO: 113073 - DNA, 2880 bp, Homo sapiens; identical to SEQ ID NO: 113071
  Payload ID: 2120
  Gene Symbol: CACFD1
  Gene Name: Calcium channel flower domain containing 1
  ENST ID: ENST00000630997
  CDS Start-End: 103-804

SEQ ID NO: 113074 - DNA, 2688 bp, Homo sapiens; identical to SEQ ID NO: 113068
  Payload ID: 2120
  Gene Symbol: CACFD1
  Gene Name: Calcium channel flower domain containing 1
  ENST ID: ENST00000625979
  CDS Start-End: 101-493

SEQ ID NO: 113075 - DNA, 2794 bp, Homo sapiens; identical to SEQ ID NO: 113069
  Payload ID: 2120
  Gene Symbol: CACFD1
  Gene Name: Calcium channel flower domain containing 1
  ENST ID: ENST00000629431
  CDS Start-End: 81-599

SEQ ID NO: 113076 - DNA, 2754 bp, Homo sapiens; identical to SEQ ID NO: 113072
  Payload ID: 2120
  Gene Symbol: CACFD1
  Gene Name: Calcium channel flower domain containing 1
  ENST ID: ENST00000627083
  CDS Start-End: 103-678

SEQ ID NO: 113077 - DNA, 356 bp, Homo sapiens; identical to SEQ ID NO: 113070
  Payload ID: 2120
  Gene Symbol: CACFD1
  Gene Name: Calcium channel flower domain containing 1
  ENST ID: ENST00000630697
  CDS Start-End: 13-356

SEQ ID NO: 113078 - DNA, 3858 bp, Homo sapiens
  Payload ID: 2121
  Gene Symbol: CACNA2D1
  Gene Name: calcium channel, voltage-dependent, alpha 2/delta subunit 1
  Uniprot ID: P54289
  ENST ID: ENST00000356253
  CDS Start-End: 257-3568
cggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagcctattggtgtaggtataccaacaattaatttaagaaaaaggagacccaatatccagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggt

SEQ ID NO: 113079 - DNA, 7563 bp, Homo sapiens
  Payload ID: 2121
  Gene Symbol: CACNA2D1
  Gene Name: calcium channel, voltage-dependent, alpha 2/delta subunit 1
  Uniprot ID: P54289
  ENST ID: ENST00000356860
  CDS Start-End: 340-3615
agggaggaaaccgagagggagagcgagagcgcgcgagcgccggcgggctcgccgaggtctgtttccaaagtcgcccttgatggcggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcatttaacagcaatgctcaggatgtaagctgttttcagcaccttgtccaagcaaatgtaagaaataaaaaagtgttgaaagacgcggtgaataatatcacagccaaaggaattacagattataagaagggctttagttttgcttttgaacagctgcttaattataatgtttccagagcaaactgcaataagattattatgctattcacggatggaggagaagagagagcccaggagatatttaacaaatacaataaagataaaaaagtacgtgtattcacgttttcagttggtcaacacaattatgacagaggacctattcagtggatggcctgtgaaaacaaaggttattattatgaaattccttccattggtgcaataagaatcaatactcaggaatatttggatgttttgggaagaccaatggttttagcaggagacaaagctaagcaagtccaatggacaaatgtgtacctggatgcattggaactgggacttgtcattactggaactcttccggtcttcaacataaccggccaatttgaaaataagacaaacttaaagaaccagctgattcttggtgtgatgggagtagatgtgtctttggaagatattaaaagactgacaccacgttttacactgtgccccaatgggtattactttgcaatcgatcctaatggttatgttttattacatccaaatcttcagccaaagaaccccaaatctcaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatcaaaaaagggcaaaatgaaggattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaacaaaagtggacctggtgcctatgaatcgggcattatggtaagcaaagctgtagaaatatatattcaagggaaacttcttaaacctgcagttgttggaattaaaattgatgtaaattcctggatagagaatttcaccaaaacctcaatcagagatccgtgtgctggtccagtttgtgactgcaaaagaaacagtgacgtaatggattgtgtgattctggatgatggtgggtttcttctgatggcaaatcatgatgattatactaatcagattggaagattttttggagagattgatcccagcttgatgagacacctggttaatatatcagtttatgcttttaacaaatcttatgattatcagtcagtatgtgagcccggtgctgcaccaaaacaaggagcaggacatcgctcagcatatgtgccatcagtagcagacatattacaaattggctggtgggccactgctgctgcctggtctattctacagcagtttctcttgagtttgacctttccacgactccttgaggcagttgagatggaggatgatgacttcacggcctccctgtccaagcagagctgcattactgaacaaacccagtatttcttcgataacgacagtaaatcattcagtggtgtattagactgtggaaactgttccagaatctttcatggagaaaagcttatgaacaccaacttaatattcataatggttgagagcaaagggacatgtccatgtgacacacgactgctcatacaagcggagcagacttctgacggtccaaatccttgtgacatggttaagcaacccagataccgaaaagggcctgatgtctgctttgataacaatgtcttggaggattatactgactgtggtggtgtttctggattaaatccctccctgtggtatatcattggaatccagtttctactactttggctggtatctggcagcacacaccgcctgttatgaccttctaaaaaccaaatctgcatagttaaactccagaccctgccaaaacatgagccctgccctcaattacagtaacgtagggtcagctataaaatcagacaaacattagctgggcctgttccatggcataacactaaggcgcagactcctaaggcacccactggctgcatgtcagggtgtcagatccttaaacgtgtgtgaatgctgcatcatctatgtgtaacatcaaagcaaaatcctatacgtgtcctctattggaaaatttgggagtttgttgttgcattgttggtgattacatgtgaaagggttccccatacaattgttaatgaaccataagaaatgtcttgatattgacctggaattttgacttgctgcaattttactaagaaaatctctaaggggaaagaaattatttttgccttcactttttcttctgtgaaaagttaattcctgctttaagtagcaattattgaaatatatagagaaagagagaattaacattggtctaaattgttgaaatataaataatggctaattttctatgaaaaatttgccatgaataaaatgccttatgaagaacggcttctttgccaaaaataaaacacaattgatgaccaattcaattttgatggggtaatgaattgatggtttgaaaatagtaactaagaaattattaaactaaaggtgcttgagggagaaattagaatatgtgacatatttcctcataaatgtaagcaagcccttaataaatgctttgatgtaatgttccttttgttcacagtacagttatgtagtgctagccagatatttaaaaatgctctaagaaaagcttgtcaggggggagggggaaatgtttttcttgtgataaatgaactttggtttaccaagggtattttgcatgatgctgctgctattttaacttttcagttgttttttctcttactgtagagtgtagtcattgaaaagttaactgagtgatattgttatgtaagaatctgaaccttgcagtgtaaatgcacttaagtcatctttaaaatgttgttaaactactctgaatatactgtgcaatgtaaatgctgaatgattggggttagataaatggtgaaatgagaattaatgaattttatacagattcatgctttcgcctgataacctatgtacagatattttaagtacataaatcagatttgacacatttattttttgaaaagtacatatatgttctcaatgaagattcatcctaggtttcctctttgttcgtttcaatagtagcacatacaatccaaaagttcctgctactgctgcttttgcccttccattttaaatggtatgatcgtttggccaaaatttccatgcaagttgataagggttttacaataatctgaacaaataggaaaccttgaatctctatgtatgcacatgaatacttgattgtgaataataaaagttgttttttatacagcctcattggtgaaaatggttagtgtagtaaatcagatatttcattatagactaatatggtagcagattatttatgcttttaaaaattattttctggagcaaacagtatttgaagaaaaggtaaaaactatgaatgtgtaattctaagaatagttaataattttactgaaggctgaacgtatgtagatattttttatgataaaatgcagtttttctttttttggaacatgccaattactggtatgtgtatatgctggaaattttcttacatatcctttttaagtcaaagttattaacattatccagcatgctttaatatgctccacatatcaaagatataaccaataatttaacgtagcttaaaagataacatttgttttgtttttagctttgcatacatttgtaattccctcccaccaccaatataccttaggtaccatttgtgtacatttcaagattttttttttcaataaaaaggtggggggaaatggaatcactttgccaactattgttctaagagttgacatcagttaccatttctaatgcattgttgtgattttgtagtgtcattcataactggtattgacattttagaaaacaccaaagtgatttaaaatatatgtggggaaaaaaacttctcactctagtaacaatgttttaatcatgttgtttgttaaatatttaaaagttattgttcaatttttgctagactatcttaaatcatgatagtgttgggaagggggtatcaaaatataaaattgttagtttgtgtatataaacaatgcacattaaaacaattgaattgcttccagcatacaacaaactaccttaaaattatgttcaaaatctattaaatatattttcatggctaatgtcgagtatatgttttcatcaattacattgttattgtattaatcgcggttaaacttggcatctcttggcaggatcctatttaatttctgttgccatcaaaatatatttatatgcatgagttttgctataaacctttattttctgctataaagttatatattatgacaaccataaatgcaattacaaattgggtaagaacaagctgaataaaagttgttcccatgactaatattagtcttcatgcttttagcatattttttaagacagtaacactcatcccatcaaattattacattacatttagtatttttctgagttacattgacaagaacttaaattatagcctgttattaatattgatttccaacgactgaacagtacaacagatcaataaaaaagtttatacactgctttaactaatttttgttatactcatgtggcttagtgtagttagtcactaaaacagagttcaagtgagcttggcaatggtgttgagtaacaagaaagaattttgcattaatgatttctttttattttcctcatttaaacaaccagcattactgccaaacaccaaccgtggtccatatttgtaacaggtttttaacatgacatagttagcaagtttgattgaagagatttttaggtcctgggcctataagattttagtatgatcttttttcatgtttctaatgcttgaggtgttactgcttaacttgggaaaaaaaaaaacaaaaaacagtgttcctgccatttgtaagttttcctataatattccttttattaactttaaaactggacttatcgggttcaaataggcagtatcccttttaagtgacctttgcaacccaagtgttacttgcttatttgatgctctcttgtattttaaatctcatttaaatctttgtctgtgaccaacaaagcttaagattttgtcttcatttaaaactctgaatctattccattgatcatgttagacgttcaaatgtttaatggtatagtctgacctagtgaaacaaaatggatgttgttactttttttaaagaatagaatgaaataactatttcacttgcccaaaattttaaatattttttcatctaaacttgtattgtttcccatagcagaatgtcaatattcacagtacatttctgtaaagagcaaaccaatataatgttttgagtgttgaaaaaaattccagatttttgaagaattagacaactcttcatctaccttatttctagttcacacagttatctcaaattccactgaaactaatgggatactgtcttgtgtagatgccagttgagtttataatgtgacctagtaaagctgtcttttttgttgtgttgtatgagtgtcggatcatgcttttaggaatacttttattaaaatggtgtgcattcatgcaaaaggccaactggcttttgtgaacaatagatcttttctcccctttattttgttctcttgacacttttgtgaaaattacctagcctgataaaaacattttgtaaaaatttgtataatactgttataaaatatttataatcccagaaaatgttgtgttaaatcttgtgcaaaaacagtatattcagaataaaagtttatcatttaaagtca

SEQ ID NO: 113080 - DNA, 1429 bp, Homo sapiens
  Payload ID: 2121
  Gene Symbol: CACNA2D1
  Gene Name: calcium channel, voltage-dependent, alpha 2/delta subunit 1
  ENST ID: ENST00000423588
  CDS Start-End: 258-1187
gcggcggaggcaaggcggccgcggcgcggagcagccgacgcacgctagtgggtccgcccgccaccgccccttcctcggcgtccgctcccgcccttgccgtcccccgcgcggctccgcgcctcgggccccgggcgcagccagccctccagacgcccgcggtcccggcggcgtgtgctgctcttcctccgcccgcggtttccagcgccgctccttcccccgcttgggcagggagggggcattgatcttcgatcgcgaagatggctgctggctgcctgctggccttgactctgacacttttccaatctttgctcatcggcccctcgtcggaggagccgttcccttcggccgtcactatcaaatcatgggtggataagatgcaagaagaccttgtcacactggcaaaaacagcaagtggagtcaatcagcttgttgatatttatgagaaatatcaagatttgtatactgtggaaccaaataatgcacgccagctggtagaaattgcagccagggatattgagaaacttctgagcaacagatctaaagccctggtgcgcctggcattggaagcggagaaagttcaagcagctcaccagtggagagaagattttgcaagcaatgaagttgtctactacaatgcaaaggatgatctcgatcctgagaaaaatgacagtgagccaggcagccagaggataaaacctgttttcattgaagatgctaattttggacgacaaatatcttatcagcacgcagcagtccatattcctactgacatctatgagggctcaacaattgtgttaaatgaactcaactggacaagtgccttagatgaagttttcaaaaagaatcgcgaggaagacccttcattattgtggcaggtttttggcagtgccactggcctagctcgatattatccagcttcaccatgggttgataatagtagaactccaaataagattgacctttatgatgtacgcagaagaccatggtacatccaaggagctgcatctcctaaagacatgcttattctggtggatgtgagtggaagtgttagtggattgacacttaaactgatccgaacatctgtctccgaaatgttagaaaccctctcagatgatgatttcgtgaatgtagcttcagatagtaaagagatttctccttctcccgaagagattttcaatgcagagtaattaaactattgtgtctctctggaggggaggatgagtgtgggccatcagaagcccctgtataagatcagggacttcctcatcttgggactcctggctggaaacccatctcactacctatgcaggtgacccctggctgtcctcctgtcatcctgtgggaattgaggtttgggcagcttgtgcaaacaaagatgttactctgctcctctgttgctatgagtaataaactctttgtctctgactca

SEQ ID NO: 113081 - DNA, 840 bp, Homo sapiens
  Payload ID: 2121
  Gene Symbol: CACNA2D1
  Gene Name: calcium channel, voltage-dependent, alpha 2/delta subunit 1
  ENST ID: ENST00000443883
  CDS Start-End: 1-840
ttaaaagactgacaccacgttttacactgtgccccaatgggtattactttgcaatcgatcctaatggttatgttttattacatccaaatcttcagccaaagcctattggtgtaggtataccaacaattaatttaagaaaaaggagacccaatatccaggagccagtaacattggatttccttgatgcagagttagagaatgatattaaagtggagattcgaaataagatgattgatggggaaagtggagaaaaaacattcagaactctggttaaatctcaagatgagagatatattgacaaaggaaacaggacatacacatggacacctgtcaatggcacagattacagtttggccttggtattaccaacctacagtttttactatataaaagccaaactagaagagacaataactcaggccagatattcggaaaccctgaagccagataattttgaagaatctggctatacattcatagcaccaagagattactgcaatgacctgaaaatatcggataataacactgaatttcttttaaatttcaacgagtttattgatagaaaaactccaaacaacccatcatgtaacgcggatttgattaatagagtcttgcttgatgcaggctttacaaatgaacttgtccaaaattactggagtaagcagaaaaatatcaagggagtgaaagcacgatttgttgtgactgatggtgggattaccagagtttatcccaaagaggctggagaaaattggcaagaaaacccagagacatatgaggacagcttctataaaaggagcctagataatgataactatgttttcactgctccctactttaaca

SEQ ID NO: 113082 - DNA, 5476 bp, Homo sapiens
  Payload ID: 2122
  Gene Symbol: CACNA2D2
  Gene Name: calcium channel, voltage-dependent, alpha 2/delta subunit 2
  Uniprot ID: Q9NY47
  ENST ID: ENST00000266039
  CDS Start-End: 175-3612
gcgcagcccgcagaggcgctgcggcccgtgcagccccggaggcccctcgcggagaaggcggcggcggaggagaggccgagttaccgcccgccgcccgcgcccccccaaccccgccgccgccgccgccgccgccactgccccccctccccgcggcgccgcatcttgaatggaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 113083 - DNA, 5272 bp, Homo sapiens
  Payload ID: 2122
  Gene Symbol: CACNA2D2
  Gene Name: calcium channel, voltage-dependent, alpha 2/delta subunit 2
  Uniprot ID: Q9NY47
  ENST ID: ENST00000360963
  CDS Start-End: 178-3408
gcgaagcgagtggctgcagagggctgcatcctgccgtccccagccccccacaaccgtacagccgtgcccaggtttccgcttagggaaccaggaggtccaggccctttctgccagcagccgggcgtgcaagcccccgacagagagaaatcttaaagatagctagagccacgggggctgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 113084 - DNA, 5206 bp, Homo sapiens
  Payload ID: 2122
  Gene Symbol: CACNA2D2
  Gene Name: calcium channel, voltage-dependent, alpha 2/delta subunit 2
  Uniprot ID: Q9NY47
  ENST ID: ENST00000424201
  CDS Start-End: 1-3432
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgt

SEQ ID NO: 113085 - DNA, 5304 bp, Homo sapiens
  Payload ID: 2122
  Gene Symbol: CACNA2D2
  Gene Name: calcium channel, voltage-dependent, alpha 2/delta subunit 2
  ENST ID: ENST00000429770
  CDS Start-End: 6-3440
gaaacatggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagtattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagcagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttc

SEQ ID NO: 113086 - DNA, 5329 bp, Homo sapiens
  Payload ID: 2122
  Gene Symbol: CACNA2D2
  Gene Name: calcium channel, voltage-dependent, alpha 2/delta subunit 2
  ENST ID: ENST00000423994
  CDS Start-End: 1-3462
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagttgccaatcagcaaactgaaggattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagcagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactgcccagcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctgagcaccctgccccaccccacctccactcccacctcacccggcctcttcgcctttcccaccctcctgccccacactccccgccttagagcctcgtccctccctcactgaaggacctgagctggccaggccctgagagtctggtctgcgccttgggatggggagtcccaaagcgggacgccgcaggtgtttggcacccaaatcacatctcacctccgaactgttcaagtgtccccagacccttcttgcctgctgggctccccccagtgggatgggacagggaggccacacgcactggtgccaaaaccaggcctctgctgccgcccttcctggaggctgcctatgttgggggggaccctgcctcagctgacccggcctctctgccccacccaagcccaaacttggtttctgtgagaatagtggaggaaggtgagatggccagtttgaagcctgtgcctcccagcttaaatcctagcaggagagaggctctggggcagcccccatgggctcctgcccctttcaggcctacagccacatccccaagcccaccaggtgtcaggatagtcacagtgataccagttcagacactaccccatatacacctggaacattgaggatggaaactggactcacattcgacataccccactgggcacacgcacaaacacacacactatggggtggggtgggtgtaggggcttacaaagccttacacagggcgaggggttggtgggagggttggcacctgcacactccatctcctgctcaccacctgcctctaatctgagctgcagcctggctggtcctcccatttctaaagctgaatgtcaaacagtgccaaatgctggggcagggggtgaagaaccctctgtcccacccctagccaccagtgtcctccaagtgccccctcacctctccaggtgctcattgtaaccatttctcactagtgtcaggcccccagtgggaccacatgccactgcctgcacctttcggcagaggaacccccaccagacatcaccctttgccttagcaggggtgactttgtctctcctggctgggccatccttccgccaatctggcccttacacactcaggcctgtgcccactccctatctccttcccacccctacacacacactccctgcttgcaggaggccaaactgtccctcccttgctgaacacacacacacacacacacacacaggtggggactgggcacagctcttcacaccattcattctggtcatttcccccaaaggcatcccagcctgggggccagtggggaactgagggcaaggggatatagtgatggggctcagatggactgggaggagggggagggtgatgcattaattaatggcttcgttaattaatgtcatgttgcttgtcgctttctcagtgtgtgtgtgtggtccatgcccactgctggtgccagggtgggtgtccatgtgcacccggcctggatgccagctgtgtccttcgggggcgtgcgtgtaactgtagtgtagtcaggtgctcaatggagaatataaacatatacagaaaaatatatattttaagtttaaaaaacagaaaaacagacaaaacaatccccatcaggtagctgtctaacccccagctgggtctaatccttctcattacccacccgacctggctgcccctcaccttgggctgggggactggggggccatttccttttctctgccctttttttgttgttctattttgtacagacaagttggaaaaacaacagcgacaaaaaagtcaagaaactttgtaaaatatcgtgtgtgtgattccttgtaaaatattttcaaatggtttattacagaagatcagttattaaataatgttcatattttcacttcaaa

SEQ ID NO: 113087 - DNA, 3453 bp, Homo sapiens
  Payload ID: 2122
  Gene Symbol: CACNA2D2
  Gene Name: calcium channel, voltage-dependent, alpha 2/delta subunit 2
  Uniprot ID: Q9NY47
  ENST ID: ENST00000479441
  CDS Start-End: 1-3453
atggcggtgccggctcggacctgcggcgcctctcggcccggcccagcgcggactgcgcgcccctggcccggctgcggcccccaccctggccccggcacccggcgcccgacgtccgggcccccgcgcccgctgtggctgctgctgccgcttctaccgctgctcgccgcccccggcgcctctgcctacagcttcccccagcagcacacgatgcagcactgggcccggcgtctggagcaggaggtcgacggcgtgatgcggatttttggaggcgtccagcagctccgtgagatttacaaggacaaccggaacctgttcgaggtacaggagaatgagcctcagaagttggtggagaaggtggcaggggacattgagagccttctggacaggaaggtgcaggccctgaagagactggctgatgctgcagagaacttccagaaagcacaccgctggcaggacaacatcaaggaggaagacatcgtgtactatgacgccaaggctgacgctgagctggacgaccctgagagtgaggatgtggaaagggggtctaaggccagcaccctaaggctggacttcatcgaggacccaaacttcaagaacaaggtcaactattcatacgcggctgtacagatccctacggacatctacaaaggctccactgtcatcctcaatgagctcaactggacagaggccctggagaatgtgttcatggaaaaccgcagacaagaccccacactgctgtggcaggtcttcggcagcgccacaggagtcactcgctactacccggccaccccgtggcgagcccccaagaagatcgacctgtacgatgtccgaaggagaccctggtatatccagggggcctcgtcacccaaagacatggtcatcatcgtggatgtgagtggcagtgtgagcggcctgaccctgaagctgatgaagacatctgtctgcgagatgctggacacgctgtctgatgatgactatgtgaatgtggcctcgttcaacgagaaggcacagcctgtgtcatgcttcacacacctggtgcaggccaatgtgcgcaacaagaaggtgttcaaggaagctgtgcagggcatggtggccaagggcaccacaggctacaaggccggctttgagtatgcctttgaccagctgcagaactccaacatcactcgggccaactgcaacaagatgatcatgatgttcacggatggtggtgaggaccgcgtgcaggacgtctttgagaagtacaattggccaaaccggacggtgcgcgtgtttactttctccgtggggcagcataactatgacgtcacaccgctgcagtggatggcctgtgccaacaaaggctactattttgagatcccttccatcggagccatccgcatcaacacacaggaatatctagatgtgttgggcaggcccatggtgctggcaggcaaggaggccaagcaggtgcagtggaccaacgtgtatgaggatgcactgggactggggttggtggtaacagggaccctccctgttttcaacctgacacaggatggccctggggaaaagaagaaccagctgatcctgggcgtgatgggcattgacgtggctctgaatgacatcaagaggctgacccccaactacacgcttggagccaacggctatgtgtttgccattgacctgaacggctacgtgttgctgcaccccaatctcaagccccagaccaccaacttccgggagcctgtgactctggacttcctggatgcggagctagaggatgagaacaaggaagagatccgtcggagcatgattgatggcaacaagggccacaagcagatcagaacgttggtcaagtccctggatgagaggtacatagatgaggtgacacggaactacacctgggtgcctataaggagcactaactacagcctggggctggtgctcccaccctacagcaccttctacctccaagccaatctcagtgaccagatcctgcaggtcaagttgccaatcagcaaactgaaggattttgagttcctgctccccagcagctttgagtctgaaggacacgttttcattgctcccagagagtactgcaaggacctgaatgcctcagacaacaacaccgagttcctgaaaaactttattgagctcatggagaaagtgactccagactccaagcagtgcaacaacttccttctgcacaacctgatcttggacacgggcatcacgcagcagctggtagagcgtgtgtggagggaccaggatctcaacacgtacagcctactggccgtgttcgctgccacagacggtggcatcacccgagtcttccccaacaaggcagctgaggactggacagagaaccctgagcccttcaatgccagcttctaccgccgcagcctggataaccacggttatgtcttcaagcccccacaccaggatgccctgttaaggccgctggagctggagaatgacactgtgggcatcctcgtcagcacagctgtggagctcagcctaggcaggcgcacactgaggccagcagtggtgggcgtcaagctggacctagaggcttgggctgagaagttcaaggtgctagccagcaaccgtacccaccaagaccagcctcagaagtgcggccccaacagccactgtgagatggactgcgaggttaacaatgaggacttactctgtgtcctcattgatgatggaggattcctggtgctgtcaaaccagaaccatcagtgggaccaggtgggcaggttcttcagtgaggtggatgccaacctgatgctggcactctacaataactccttctacacccgcaaggagtcctatgactatcaggcagcctgtgcccctcagccccctggcaacctgggtgctgcaccccggggtgtctttgtgcccaccgttgcagatttccttaacctggcctggtggacctctgctgccgcctggtccctgttccagcagcttctctacggcctcatctaccacagctggttccaagcagaccccgcggaggccgaggggagccccgagacgcgcgagagcagctgcgtcatgaaacagacccagtactacttcggctcggtaaacgcctcctacaacgccatcatcgactgcggaaactgctccaggctgttccacgcgcagagactgaccaacaccaatcttctctttgtggtggccgagaagccgctgtgcagccagtgcgaggctggccggctgctgcagaaggagacgcactcggacggcccggagcagtgtgagctagtgcagagaccgcgataccggagaggcccgcacatctgcttcgactacaacgcgacagaagatacctcagactgtggccgcggggcctccttcccgccgtcgctgggcgtcctggtctccctgcaactgctgctcctcctgggcctgccgccccggccgcagcctcaagtcctcgtccacgcctctcgccgcctctga

SEQ ID NO: 113088 - DNA, 3671 bp, Homo sapiens
  Payload ID: 2123
  Gene Symbol: CACNA2D3
  Gene Name: calcium channel, voltage-dependent, alpha 2/delta subunit 3
  Uniprot ID: Q8IZS8
  ENST ID: ENST00000288197
  CDS Start-End: 49-3324
cggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatc

SEQ ID NO: 113089 - DNA, 3661 bp, Homo sapiens
  Payload ID: 2123
  Gene Symbol: CACNA2D3
  Gene Name: calcium channel, voltage-dependent, alpha 2/delta subunit 3
  Uniprot ID: Q8IZS8
  ENST ID: ENST00000415676
  CDS Start-End: 119-3394
cacccgctcctttttctgctccccaagtgagccgcgcgctcgcccaccgcccgctccgcgcagctccccgcggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtg

SEQ ID NO: 113090 - DNA, 3557 bp, Homo sapiens
  Payload ID: 2123
  Gene Symbol: CACNA2D3
  Gene Name: calcium channel, voltage-dependent, alpha 2/delta subunit 3
  Uniprot ID: Q8IZS8
  ENST ID: ENST00000490478
  CDS Start-End: 213-3206
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 113091 - DNA, 1972 bp, Homo sapiens
  Payload ID: 2123
  Gene Symbol: CACNA2D3
  Gene Name: calcium channel, voltage-dependent, alpha 2/delta subunit 3
  ENST ID: ENST00000477024
  CDS Start-End: 195-1772
gttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtatt

SEQ ID NO: 113092 - DNA, 1826 bp, Homo sapiens
  Payload ID: 2123
  Gene Symbol: CACNA2D3
  Gene Name: calcium channel, voltage-dependent, alpha 2/delta subunit 3
  ENST ID: ENST00000468658
  CDS Start-End: 216-356
tatttaagcatctgtaggaacatgctgacagcctacttcaagtcctcctctcctttcagttttcaggaaactgtgtactgcctgacttcagtgtgggtccacctctggcatctttatagtagcagaacttattcgaaaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagt

SEQ ID NO: 113093 - DNA, 559 bp, Homo sapiens
  Payload ID: 2123
  Gene Symbol: CACNA2D3
  Gene Name: calcium channel, voltage-dependent, alpha 2/delta subunit 3
  ENST ID: ENST00000492460
  CDS Start-End: 182-559
cccctatatttatctttaacctcaagtgaatgttgctgcctttgtagttcatgagcaatgtatactcttgaattccagctctgtgaaatcggtagaaaatgagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttt

SEQ ID NO: 113094 - DNA, 3477 bp, Homo sapiens
  Payload ID: 2123
  Gene Symbol: CACNA2D3
  Gene Name: calcium channel, voltage-dependent, alpha 2/delta subunit 3
  Uniprot ID: Q8IZS8
  ENST ID: ENST00000471363
  CDS Start-End: 213-1772
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 113095 - DNA, 3675 bp, Homo sapiens
  Payload ID: 2123
  Gene Symbol: CACNA2D3
  Gene Name: calcium channel, voltage-dependent, alpha 2/delta subunit 3
  Uniprot ID: Q8IZS8
  ENST ID: ENST00000474759
  CDS Start-End: 49-3324
cggccgctctcgtcgccgccgcagcgggcgcgtcggagggagcccagcatggccgggccgggctcgccgcgccgcgcgtcccggggggcctcggcgcttctcgctgccgcgcttctctacgccgcgctgggggacgtggtgcgctcggagcagcagataccgctctccgtggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctccctcaggcacaaaagctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggaaacgggttttggtgatgacaaatgactactattatacagacatcaagggtactcctttcagtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgttgacaaaaagttatctatcatctttttactttgccagtcatgcaaatgtgagtttgccacatgataatcacccttcatcagaaatgggaccgcaagtggtaggcagtgtcccttctgcttgaaacctattgaaaccaatttaaaactgtgtactttttaaataaagtatattaaaatcataa

SEQ ID NO: 113096 - DNA, 3296 bp, Homo sapiens
  Payload ID: 2123
  Gene Symbol: CACNA2D3
  Gene Name: calcium channel, voltage-dependent, alpha 2/delta subunit 3
  Uniprot ID: Q8IZS8
  ENST ID: ENST00000620722
  CDS Start-End: 213-1772
gttgactgtgacacgggtgttacatatcttcctgtgccccttctccctgtagggtgaagctctgggcctcggcttttggtggggagataaaatccattgctgctaagtactccggttcccagcttctgcaaaagaaatacaaagagtatgagaaagacgttgccatagaagaaattgatggcctccaactggtaaagaagctggcaaagaacatggaagagatgtttcacaagaagtctgaggccgtcaggcgtctggtggaggctgcagaagaagcacacctgaaacatgaatttgatgcagacttacagtatgaatacttcaatgctgtgctgataaatgaaagggacaaagacgggaattttttggagctgggaaaggaattcatcttagccccaaatgaccattttaataatttgcctgtgaacatcagtctaagtgacgtccaagtaccaacgaacatgtacaacaaagaccctgcaattgtcaatggggtttattggtctgaatctctaaacaaagtttttgtagataactttgaccgtgacccatctctcatatggcagtactttggaagtgcaaagggcttttttaggcagtatccggggattaaatgggaaccagatgagaatggagtcattgccttcgactgcaggaaccgaaaatggtacatccaggcagcaacttctccgaaagacgtggtcattttagttgacgtcagtggcagcatgaaaggactccgtctgactatcgcgaagcaaacagtctcatccattttggatacacttggggatgatgacttcttcaacataattgcttataatgaggagcttcactatgtggaaccttgcctgaatggaactttggtgcaagccgacaggacaaacaaagagcacttcagggagcatctggacaaacttttcgccaaaggaattggaatgttggatatagctctgaatgaggccttcaacattctgagtgatttcaaccacacgggacaaggaagtatctgcagtcaggccatcatgctcataactgatggggcggtggacacctatgatacaatctttgcaaaatacaattggccagatcgaaaggttcgcatcttcacatacctcattggacgagaggctgcgtttgcagacaatctaaagtggatggcctgtgccaacaaaggattttttacccagatctccaccttggctgatgtgcaggagaatgtcatggaataccttcacgtgcttagccggcccaaagtcatcgaccaggagcatgatgtggtgtggaccgaagcttacattgacagcactctgactgatgatcagggccccgtcctgatgaccactgtagccatgcctgtgtttagtaagcagaacgaaaccagatcgaagggcattcttctgggagtggttggcacagatgtcccagtgaaagaacttctgaagaccatccccaaatacaagttagggattcacggttatgcctttgcaatcacaaataatggatatatcctgacgcatccggaactcaggctgctgtacgaagaaggaaaaaagcgaaggaaacctaactatagtagcgttgacctctctgaggtggagtgggaagaccgagatgacgtgttgagaaatgctatggtgaatcgaaagacggggaagttttccatggaggtgaagaagacagtggacaaagggtttaggtgtggcgctttccagaggtcatgggaaatatttcttccgagggaatgtaaccatcgaagaaggcctgcatgacttagaacatcccgatgtgtccttggcagatgaatggtcctactgcaacactgacctacaccctgagcaccgccatctgtctcagttagaagcgattaagctctacctaaaaggcaaagaacctctgctccagtgtgataaagaattgatccaagaagtcctttttgacgcggtggtgagtgcccccattgaagcgtattggaccagcctggccctcaacaaatctgaaaattctgacaagggcgtggaggttgccttcctcggcactcgcacgggcctctccagaatcaacctgtttgtcggggctgagcagctcaccaatcaggacttcctgaaagctggcgacaaggagaacatttttaacgcagaccatttccctctctggtaccgaagagccgctgagcagattccagggagcttcgtctactcgatcccattcagcactggaccagtcaataaaagcaatgtggtgacagcaagtacatccatccagctcctggatgaacggaaatctcctgtggtggcagctgtaggcattcagatgaaacttgaatttttccaaaggaagttctggactgccagcagacagtgtgcttccctggatggcaaatgctccatcagctgtgatgatgagactgtgaattgttacctcatagacaataatggatttattttggtgtctgaagactacacacagactggagacttttttggtgagatcgagggagctgtgatgaacaaattgctaacaatgggctcctttaaaagaattaccctttatgactaccaagccatgtgtagagccaacaaggaaagcagcgatggcgcccatggcctcctggatccttataatgccttcctctctgcagtaaaatggatcatgacagaacttgtcttgttcctggtggaatttaacctctgcagttggtggcactccgatatgacagctaaagcccagaaattgaaacagaccctggagccttgtgatactgaatatccagcattcgtctctgagcgcaccatcaaggagactacagggaatattgcttgtgaagactgctccaagtcctttgtcatccagcaaatcccaagcagcaacctgttcatggtggtggtggacagcagctgcctctgtgaatctgtggcccccatcaccatggcacccattgaaatcaggtataatgaatcccttaagtgtgaacgtctaaaggcccagaagatcagaaggcgcccagaatcttgtcatggcttccatcctgaggagaatgcaagggagtgtgggggtgcgccgagtctccaagcccagacagtcctccttctgctccctctgcttttgatgctcttctcaaggtgacactgactgagatgttctcttactgactgagatgttctcttggcatgctaaatcatggataaactgtgaaccaaaatatggtgcaacatacgagacatgaatatagtccaaccatcagcatctcatcatgattttaaactgtgcgtgatataaactcttaaagatatgtt

SEQ ID NO: 113097 - DNA, 5475 bp, Homo sapiens
  Payload ID: 2124
  Gene Symbol: CACNA2D4
  Gene Name: calcium channel, voltage-dependent, alpha 2/delta subunit 4
  Uniprot ID: Q7Z3S7
  ENST ID: ENST00000382722
  CDS Start-End: 364-3777
cacaggaacggggctgcctctttaaagcagaggggtgcactatagccctgagggaaccagctgcagttgtggtaatcttgggaggcagctccccaccccctgccaccccctccctgctgtcaggagaggattagaggagaggccagcggattaaagggtttcatgttgccacagcctctcccccagtccctgtctccgaggcctgcttgctaggtggggcgactcttctgtgagctgcagctgtggggcagagagaagccctccccacccaggactgagaggctggagaccccaggctcgccaaggcacggaagacaaaggcctggggcgtcctggggtctgggaggaaggcagacagagctcatggtctgtggctgctctgccctccttcccctccccaaccccaggcccaccatgcctgcaactcccaacttcctcgcaaaccccagctccagcagccgctggattcccctccagccaatgcccgtggcctgggcctttgtgcagaagacctcggccctcctgtggctgctgcttctaggcacctccctgtcccctgcgtggggacaggccaagattcctctggaaacagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttccccccgctcctccatcaccctcagcctccacacttcaaagttcaagttcaaagctgttcaagtttcctaccagcaaatagccctaacttgcctctagagtaggccaaatgccaactctgtaaaacacacttacattatcggttacagaatgtcactcttaccgtcatgtcttgcaacaaccctgtgagggcagtattaatgcccccttacagcagaagacactgcagctcgaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcgatcatta

SEQ ID NO: 113098 - DNA, 4450 bp, Homo sapiens
  Payload ID: 2124
  Gene Symbol: CACNA2D4
  Gene Name: calcium channel, voltage-dependent, alpha 2/delta subunit 4
  ENST ID: ENST00000444595
  CDS Start-End: 165-1970
ggcctgcttgctaggtggggcgactcttctgtgagctgcagctgtggggcagagagaagccctccccacccaggactgagaggctggagaccccaggctcgccaaggcacggaagacaaaggcctggggcgtcctggggtctgggaggaaggcagacagagctcatggtctgtggctgctctgccctccttcccctccccaaccccaggcccaccatgcctgcaactcccaacttcctcgcaaaccccagctccagcagccgctggattcccctccagccaatgcccgtggcctgggcctttgtgcagaagacctcggccctcctgtggctgctgcttctaggcacctccctgtcccctgcgtggggacaggccaagattcctctggaaacagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagatgcccagcacaaacagcaggcctaatgcgcctccaccctggactctggcagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctg

SEQ ID NO: 113099 - DNA, 2876 bp, Homo sapiens
  Payload ID: 2124
  Gene Symbol: CACNA2D4
  Gene Name: calcium channel, voltage-dependent, alpha 2/delta subunit 4
  ENST ID: ENST00000537784
  CDS Start-End: 1-577
ggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaatgatttacaaaagaatctacttgactctgtccctggagtgaaatccttagggttggaacttgtgggaacattccaacttgctaagcagggtccactgggagggaagctctatctgggaactcacccccagcgcacacacatctcccccagggtcccaaggccccgcagcttcctcccccgaccaaaccccaagacctggatcccaggagacaacagtctccacagtgagagcaacattaagggcaaagccatggagaaatgtgggagaggccggcctcaaatctttccatttaacaaaccccagtgatgggtatggacagcatgcagggcttttggggcgcttccccccgctcctccatcaccctcagcctccacacttcaaagttcaagttcaaagctgttcaagtttcctaccagcaaatagccctaacttgcctctagagtaggccaaatgccaactctgtaaaacacacttacattatcggttacagaatgtcactcttaccgtcatgtcttgcaacaaccctgtgagggcagtattaatgcccccttacagcagaagacactgcagctcgaagacagcttaagtggcagaataatgctagaacagctaaggtttacatgtaccaaataacatgtttcagctcattccatcctcacaacagccccctgaaagtgggtactatcattagtcccatgttatagaaactgcagcagagttgaaaattgcctccaaattaccggaagagtgtatgaagattgaatgtgatgtattcacgtaacatgcttgaaactgcctggcatatactaaacgctaaataaatacatgctaactgcga

SEQ ID NO: 113100 - DNA, 1615 bp, Homo sapiens
  Payload ID: 2124
  Gene Symbol: CACNA2D4
  Gene Name: calcium channel, voltage-dependent, alpha 2/delta subunit 4
  Uniprot ID: Q7Z3S7
  ENST ID: ENST00000545595
  CDS Start-End: 30-155
ctttctgccctgtagccgcgggcgtccaaatgaagctggaattcctccagcgcaaattctgggcggcaacgcggcaggatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactgagaaaggaatgaaatccattcaggaaatatcgacagggctacacgtgatgtccccaaactgctgctattgaagaacttcccaaaacttctttacaaagccctaaaggaaagtttgcatctatgaaaagccaataggctgagacatccaattgctgcatggaaattgatgtacattcaggggacggcaaaaatagctgtaaaatagtgaaaaagagcagtggttgtgctcttttctggccaa

SEQ ID NO: 113101 - DNA, 952 bp, Homo sapiens
  Payload ID: 2124
  Gene Symbol: CACNA2D4
  Gene Name: calcium channel, voltage-dependent, alpha 2/delta subunit 4
  ENST ID: ENST00000538027
  CDS Start-End: 52-900
cttccctggccttgccctctctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcc

SEQ ID NO: 113102 - DNA, 1498 bp, Homo sapiens
  Payload ID: 2124
  Gene Symbol: CACNA2D4
  Gene Name: calcium channel, voltage-dependent, alpha 2/delta subunit 4
  ENST ID: ENST00000538450
  CDS Start-End: 83-886
aacttgactctatttttttctctccccgtctcttccctggccttgccctctctctttctgccctgtagccgcgggcgtccaaatgaagctggaattcctccagcgcaaattctgggcggcaacgcggcaggatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgccccaactaaagcatagattccccaaagtgaggctcatggtgggaggccactcaccttcctagctgctgctcgaaaaggttttgactgtgttggggtgggggttgggtaagggaatggtcaagactg

SEQ ID NO: 113103 - DNA, 556 bp, Homo sapiens
  Payload ID: 2124
  Gene Symbol: CACNA2D4
  Gene Name: calcium channel, voltage-dependent, alpha 2/delta subunit 4
  ENST ID: ENST00000537923
  CDS Start-End: 32-202
ctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgcttgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagt

SEQ ID NO: 113104 - DNA, 3499 bp, Homo sapiens
  Payload ID: 2124
  Gene Symbol: CACNA2D4
  Gene Name: calcium channel, voltage-dependent, alpha 2/delta subunit 4
  Uniprot ID: Q7Z3S7
  ENST ID: ENST00000586184
  CDS Start-End: 1-3465
atggtctgtggctgctctgccctccttcccctccccaaccccaggcccaccatgcctgcaactcccaacttcctcgcaaaccccagctccagcagccgctggattcccctccagccaatgcccgtggcctgggcctttgtgcagaagacctcggccctcctgtggctgctgcttctaggcacctccctgtcccctgcgtggggacaggccaagattcctctggaaacagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggtgcgggttgaggcggatcgagggtgggctggattttcatccccaaaccctctgtgcctgggtctgtgcccctgcagacaggagcatatagggatgccaatgaacacacctgtgcctgtgcttctcgggggaaacattcgcgtttatgccctgtgacactgtgatataataagaaacagatctttattta

SEQ ID NO: 113105 - DNA, 3883 bp, Homo sapiens
  Payload ID: 2124
  Gene Symbol: CACNA2D4
  Gene Name: calcium channel, voltage-dependent, alpha 2/delta subunit 4
  ENST ID: ENST00000587995
  CDS Start-End: 59-3397
gcacggaagacaaaggcctggggcgtcctggggtctgggaggaaggcagacagagctcatggtctgtggctgctctgccctccttcccctccccaaccccaggcccaccatgcctgcaactcccaacttcctcgcaaaccccagctccagcagccgctggattcccctccagccaatgcccgtggcctgggcctttgtgcagaagacctcggccctcctgtggctgctgcttctaggcacctccctgtcccctgcgtggggacaggccaagattcctctggaaacagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctccggagaatgctggatggaacaggaaaccaatcacctggcaccactttcaagatgcttcatggtgcccggtaccatctgccctaggtctcaacatgagcatacttctgacctaaccttcctgtctcctcttcgggaagccagcgtgagctcagcttggaccaagacaaaataatttagttcttcctgtactccagagtccagacccagccaagaaagggtcagttgtttctgaccctttctgtcggagtggtctctggtagaacccaaggacttctgggtactgagaagcagcagcagaatgaggccaaatgcagagatgaggctaaggcaagaatatgc

SEQ ID NO: 113106 - DNA, 976 bp, Homo sapiens
  Payload ID: 2124
  Gene Symbol: CACNA2D4
  Gene Name: calcium channel, voltage-dependent, alpha 2/delta subunit 4
  ENST ID: ENST00000585385
  CDS Start-End: 52-222
cttccctggccttgccctctctctttctgccctgtagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgcagttgggtcgcccccaggccaacgctcctctcaatcctgggctggtggcccctggctc

SEQ ID NO: 113107 - DNA, 3273 bp, Homo sapiens
  Payload ID: 2124
  Gene Symbol: CACNA2D4
  Gene Name: calcium channel, voltage-dependent, alpha 2/delta subunit 4
  Uniprot ID: Q7Z3S7
  ENST ID: ENST00000585708
  CDS Start-End: 1-3273
atggctgtagctttagggacaaggaggagggacagagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggtgcgggttgaggcggatcgagggtgggctggattttcatccccaaaccctctgtgcctgggtctgtgcccctgcagacaggagcatatagggatgccaatgaacacacctgtgcctgtgcttctcgggggaaacattcgcgtttatgccctgtga

SEQ ID NO: 113108 - DNA, 2566 bp, Homo sapiens
  Payload ID: 2124
  Gene Symbol: CACNA2D4
  Gene Name: calcium channel, voltage-dependent, alpha 2/delta subunit 4
  ENST ID: ENST00000585732
  CDS Start-End: 74-2416
cccaggctcgccaaggcacggaagacaaaggcctggggcgtcctggggtctgggaggaaggcagacagagctcatggtctgtggctgctctgccctccttcccctccccaaccccaggcccaccatgcctgcaactcccaacttcctcgcaaaccccagctccagcagccgctggattcccctccagccaatgcccgtggcctgggcctttgtgcagaagacctcggccctcctgtggctgctgcttctaggcacctccctgtcccctgcgtggggacaggccaagattcctctggaaacagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagccaggaatcaaactgagaaagaagcccattcaaacctgaagcaaatccagatatattcaccagatgtatttccttgaagcaaggcagaagcatcagaaccgcctcctgcctgagcctcggggaaaggggcatagtatttggttctgtgtgagctttgctactaattagaaacgtgatgtgggcaagcga

SEQ ID NO: 113109 - DNA, 895 bp, Homo sapiens
  Payload ID: 2124
  Gene Symbol: CACNA2D4
  Gene Name: calcium channel, voltage-dependent, alpha 2/delta subunit 4
  ENST ID: ENST00000536846
  CDS Start-End: 1-854
cgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctgccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttc

SEQ ID NO: 113110 - DNA, 3311 bp, Homo sapiens
  Payload ID: 2124
  Gene Symbol: CACNA2D4
  Gene Name: calcium channel, voltage-dependent, alpha 2/delta subunit 4
  Uniprot ID: Q7Z3S7
  ENST ID: ENST00000588077
  CDS Start-End: 1-3222
atggctgtagctttagggacaaggaggagggacagagtgaagctatgggctgacaccttcggcggggacctgtataacactgtgaccaaatactcaggctctctcttgctgcagaagaagtacaaggatgtggagtccagtctgaagatcgaggaggtggatggcttggagctggtgaggaagttctcagaggacatggagaacatgctgcggaggaaagtcgaggcggtccagaatctggtggaagctgccgaggaggccgacctgaaccacgaattcaatgaatccctggtgttcgactattacaactcggtcctgatcaacgagagggacgagaagggcaacttcgtggagctgggcgccgagttcctcctggagtccaatgctcacttcagcaacctgccggtgaacacctccatcagcagcgtgcagctgcccaccaacgtgtacaacaaagacccagatattttaaatggagtctacatgtctgaagccttgaatgctgtcttcgtggagaacttccagagagacccaacgttgacctggcaatattttggcagtgcaactggattcttcaggatctatccaggtataaaatggacacctgatgagaatggagtcattacttttgactgccgaaaccgcggctggtacattcaagctgctacttctcccaaggacatagtgattttggtggacgtgagcggcagtatgaaggggctgaggatgactattgccaagcacaccatcaccaccatcttggacaccctgggggagaatgacttcattaatatcatagcgtacaatgactacgtccattacatcgagccttgttttaaagggatcctcgtccaggcggaccgagacaatcgagagcatttcaaactgctggtggaggagttgatggtcaaaggtgtgggggtcgtggaccaagccctgagagaagccttccagatcctgaagcagttccaagaggccaagcaaggaagcctctgcaaccaggccatcatgctcatcagcgacggcgccgtggaggactacgagccggtgtttgagaagtataactggccagactgtaaggtccgagttttcacttacctcattgggagagaagtgtcttttgctgaccgcatgaagtggattgcatgcaacaacaaaggctactacacgcagatctcaacgctggcggacacccaggagaacgtgatggaatacctgcacgtgctcagccgccccatggtcatcaaccacgaccacgacatcatctggacagaggcctacatggacagcaagctcctcagctcgcaggctcagagcctgacactgctcaccactgtggccatgccagtcttcagcaagaagaacgaaacgcgatcccatggcattctcctgggtgtggtgggctcagatgtggccctgagagagctgatgaagctggcgccccggtacaagcttggagtgcacggatacgcctttctgaacaccaacaatggctacatcctctcccatcccgacctccggcccctgtacagagaggggaagaaactaaaacccaaacctaactacaacagtgtggatctctccgaagtggagtgggaagaccaggctgaatctctgagaacagccatgatcaatagggaaacaggtactctctcgatggatgtgaaggttccgatggataaagggaagcgagttcttttcctgaccaatgactacttcttcacggacatcagcgacacccctttcagtttgggggtggtgctgtcccggggccacggagaatacatccttctggggaacacgtctgtggaagaaggcctgcatgacttgcttcacccagacctggccctggccggtgactggatctactgcatcacagatattgacccagaccaccggaagctcagccagctagaggccatgatccgcttcctcaccaggaaggacccagacctggagtgtgacgaggagctggtccgggaggtgctgtttgacgcggtggtgacagcccccatggaagcctactggacagcgctggccctcaacatgtccgaggagtctgaacacgtggtggacatggccttcctgggcacccgggctggcctcctgagaagcagcttgttcgtgggctccgagaaggtctccgacaggaagttcctgacacctgaggacgaggccagcgtgttcaccctggaccgcttcccgctgtggtaccgccaggcctcagagcatcctgctggcagcttcgtcttcaacctccgctgggcagaaggaccagaaagtgcgggtgaacccatggtggtgacggcaagcacagctgtggcggtgaccgtggacaagaggacagccattgctgcagccgcgggcgtccaaatgaagctggaattcctccagcgcaaattctgggcggcaacgcggcagtgcagcactgtggatgggccgtgcacacagagctgcgaggacagtgatctggactgcttcgtcatcgacaacaacgggttcattctgatctccaagaggtcccgagagacgggaagatttctgggggaggtggatggtgctgtcctgacccagctgctcagcatgggggtgttcagccaagtgactatgtatgactatcaggccatgtgcaaaccctcgagtcaccaccacagtgcagcccagcccctggtcagcccaatttctgccttcttgacggcgaccaggtggctgctgcaggagctggtgctgttcctgctggagtggagtgtctggggctcctggtacgacagaggggccgaggccaaaagtgtcttccatcactcccacaaacacaagaagcaggacccgctgcagccctgcgacacggagtaccccgtgttcgtgtaccagccggccatccgggaggccaacgggatcgtggagtgcgggccctgccagaaggtatttgtggtgcagcagattcccaacagtaacctcctcctcctggtgacagaccccacctgtgactgcagcatcttcccaccagtgctgcaggaggcgacagaagtcaaatataatgcctctgtcaaatgtgaccggatgcgctcccagaagctccgccggcgaccagactcctgccacgccttccatccagaggagaatgcccaggactgcggcggcgcctcggacacctcagcctcgccgcccctactcctgctgcctgtgtgtgcctgggggctactgccccaactcctgcggtgacaccacccagcctgacctgtgttttggcaaggtgatccttccagagccatcccaaaaagtcagcactgacatgggatgcagctaactgc

SEQ ID NO: 113111 - DNA, 1889 bp, Homo sapiens
  Payload ID: 2125
  Gene Symbol: CACNB1
  Gene Name: calcium channel, voltage-dependent, beta 1 subunit
  Uniprot ID: Q02641
  ENST ID: ENST00000344140
  CDS Start-End: 209-1780
gagatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtggtaatgaaatgactaacttagcctttgaactagaccccctagagttagaggaggaagaggctgagcttggtgagcagagtggctctgccaagactagtgttagcagtgtcaccaccccgccaccccatggcaaacgcatccccttctttaagaagacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggca

SEQ ID NO: 113112 - DNA, 3742 bp, Homo sapiens
  Payload ID: 2125
  Gene Symbol: CACNB1
  Gene Name: calcium channel, voltage-dependent, beta 1 subunit
  Uniprot ID: Q02641
  ENST ID: ENST00000394303
  CDS Start-End: 209-2005
gagatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgtgcccaagccaggagctgcttgggcagtcccagctccacactggccctgagccccttcacttacctgtctctccacaagtagagccaaaggcaatgggaagctcaatgttgctcagtgggtgagatccagacccactggtgcaatgtcttaaatacacatgactgtttttc

SEQ ID NO: 113113 - DNA, 1753 bp, Homo sapiens
  Payload ID: 2125
  Gene Symbol: CACNB1
  Gene Name: calcium channel, voltage-dependent, beta 1 subunit
  Uniprot ID: Q02641
  ENST ID: ENST00000394310
  CDS Start-End: 208-1644
agatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgccaaacagaagcagaagtcgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccaggtacaggtgctcacctcgctcaggagaaacctcggcttctggggcgggctggagtcctcacagcggggcagtgtggtgccccaggagcaggaacatgccatgtagtgggcgccctgcccgtcttccctcctgctctggggtcggaactggagtgcagggaacatggaggaggaagggaagagctttattttgtaaaaaaataagatgagcggca

SEQ ID NO: 113114 - DNA, 3722 bp, Homo sapiens
  Payload ID: 2125
  Gene Symbol: CACNB1
  Gene Name: calcium channel, voltage-dependent, beta 1 subunit
  ENST ID: ENST00000622445
  CDS Start-End: 209-859
gagatgctgagcctacgggggaggcggcggcggcagtggagagagcgggaggagcgagggaaggcaggaaggaggcagccgaaggccgagctgggtggctggaccgggtgctggctgcgccgcgctgctttcggctcccacggcctctcccatgcgctgagggagcccggctgggccgggccggcggcgggaggggaggctcctctccatggtccagaagaccagcatgtcccggggcccttacccaccctcccaggagatccccatggaggtcttcgaccccagcccgcagggcaaatacagcaagaggaaagggcgattcaaacggtcagatgggagcacgtcctcggataccacatccaacagctttgtccgccagggctcagcggagtcctacaccagccgtccatcagactctgatgtatctctggaggaggaccgggaagccttaaggaaggaagcagagcgccaggcattagcgcagctcgagaaggccaagaccaagccagtggcatttgctgtgcggacaaatgttggctacaatccgtctccaggggatgaggtgcctgtgcagggagtggccatcaccttcgagcccaaagacttcctgcacatcaaggagaaatacaataatgactggtggatcgggcggctggtgaaggagggctgtgaggttggcttcattcccagccccgtcaaactggacagccttcgcctgctgcaggaacagaagctgcgccagaaccgcctcggctccagcaaatcaggcgataactccagttccagtctgggagatgtggtgactggcacccgccgccccacaccccctgccagtgacagagcatgtgcccccctatgacgtggtgccttccatgaggcccatcatcctggtgggaccgtcgctcaagggctacgaggttacagacatgatgcagaaagctttatttgacttcttgaagcatcggtttgatggcaggatctccatcactcgtgtgacggcagatatttccctggctaagcgctcagttctcaacaaccccagcaaacacatcatcattgagcgctccaacacacgctccagcctggctgaggtgcagagtgaaatcgagcgaatcttcgagctggcccggacccttcagttggtcgctctggatgctgacaccatcaatcacccagcccagctgtccaagacctcgctggcccccatcattgtttacatcaagatcacctctcccaaggtacttcaaaggctcatcaagtcccgaggaaagtctcagtccaaacacctcaatgtccaaatagcggcctcggaaaagctggcacagtgcccccctgaaatgtttgacatcatcctggatgagaaccaattggaggatgcctgcgagcatctggcggagtacttggaagcctattggaaggccacacacccgcccagcagcacgccacccaatccgctgctgaaccgcaccatggctaccgcagccctggctgccagccctgcccctgtctccaacctccagggaccctaccttgcttccggggaccagccactggaacgggccaccggggagcacgccagcatgcacgagtacccaggggagctgggccagcccccaggcctttaccccagcagccacccaccaggccgggcaggcacgctacgggcactgtcccgccaagacacttttgatgccgacacccccggcagccgaaactctgcctacacggagctgggagactcatgtgtggacatggagactgacccctcagaggggccagggcttggagaccctgcagggggcggcacgcccccagcccgacagggatcctgggaggacgaggaagaagactatgaggaagagctgaccgacaaccggaaccggggccggaataaggcccgctactgcgctgagggtgggggtccagttttggggcgcaacaagaatgagctggagggctggggacgaggcgtctacattcgctgagaggcaggggccacacggcgggaggaagggctctgagcccaggggaggggagggagcgaggggctcacacctgacatgtattcgcctccagggggcgctgtctccctcctttcagatgcctttgctcaaagcttggggtttctttggtgttaccatcccagctcccgggaggcccttaagccccagctgtcggtttttacctgcctgttgtggatggatgggggatacccacctttctgaagtgtcccctttctcccatcttaaggggctctcctccctcaccctcctagagaaaaggtgcacttccttaactctttctactcggggccctaagtgacggtcctaagtgggatggctctccttctcccaagctgcagtactggggaagggctgggcgcttttcctggaaagggaggccacagattctttcccatgggggctctcttccccagaccccagatccaaggtccctcaccctgcctgccccttcctcccagcttcctggcagcatcgtctggtcggtgaaagccatagcatggacaccccatggggagcttgtcttggggagggttctgggtggaagctggcaggcatacagcaccctctaccctccgtggccatggcaacgtccagggcccagaaccctgaggagtgagcggccgagacgctgctccccaccccccacctccatgcctcagcctttgcctaccccaggaatgagcttggcctccaacatcccttgcctgctgccattagtagagggggcccctctgcatctgagccccccatccctgtgccacctgggtgtggagcccatggaacactctggtccgcctcattttaaaccaaaaaactgctccttcaccctcaccctgaggccccaggggagaggacccgtgggatggtgcccaggggttgccttgggacctcggatctcctctggggggcttggctgctgctgttgctgctctgtatttgcctctcgtgattctgtttgttacccatgttcacttcccccaggagaggccttggtaccccctctcccctggggcatccctttgccttggcatccctgtagcccagcaaccctgcccctccccagcatcccagctgggccagagagagccgagtgtgccaacaaggactggggcctgcccggctgcccgcctcagggatgggcacctcatgcctgtctcgccacctcctgtgccaatgtcccaccctccacctgggggtggggtgcagcttccacttactgattagaagacaccactgccctcccttcccccctccctgtctggtgtcctgtgcccccatctgtctgtctatatttgtctgtactcccctaggagaagtattttgccatatataaaaccactgtcctgtcctttgtggctgcctcccaagcctgcttctttgtcctcgccacatagtcgtcagcgtaggcacctgggagctgctgatatgcacggggagttgaaagggtgggtgcctgaagatgttgtgccctgagtcattgactcaaaagaaaagatgatcctttgattttggccctctgatgtattgtgcccaagccaggagctgcttgggcagtcccagctccacactggccctgagccccttcacttacctgtctctccacaagtagagccaaaggcaatgggaagctcaatgttgctcagtgggtgagatccagacccactggtgcaatgtcttaaatacacatgactgtttttc

SEQ ID NO: 113115 - DNA, 3524 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000282343
  CDS Start-End: 223-2121
cacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatctcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 113116 - DNA, 3446 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000324631
  CDS Start-End: 61-2043
gaggaggaggggacccgccgccgggggctggctgcttcgctccgagccgacttttcgccaatggtccaaagggacatgtccaagtcgcctcccacagcggcggcggcggtggcgcaggagatccagatggaactgctagagaacgtggctcccgcgggggcgctcggagccgccgcacagtcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 113117 - DNA, 1911 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000352115
  CDS Start-End: 1-1911
atggtccaaagggacatgtccaagtcgcctcccacagcggcggcggcggtggcgcaggagatccagatggaactgctagagaacgtggctcccgcgggggcgctcggagccgccgcacagtcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctggtgcaaaatctgcagatgaacaagaccagtggaaaactgcaggcttgttttggcggtttactacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatga

SEQ ID NO: 113118 - DNA, 3461 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000377315
  CDS Start-End: 220-2058
gtgtgttttcagcccctcctggaatgggaaaataagaatctccctggatgggagtcctctggggcagggagtgaaagccccggaggcagaaagggacggagaacaggggcttgcccagagcatggataggaaaggagctggggttctccggggctcagcgcgcactgagaacctgtgcccggggctgcagctgcggacgataaaggcgctgtctggctcatgaaggccacctggatcaggcttctgaaaagagccaagggaggaaggctgaagaattctgatatctgtggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 113119 - DNA, 3116 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000377319
  CDS Start-End: 10-1713
cccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctaagcagaagcagaaatcgacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaacctt

SEQ ID NO: 113120 - DNA, 1233 bp, Homo sapiens
  Payload ID: 2126
  Gene Symbol: CACNB2
  Gene Name: calcium channel, voltage-dependent, beta 2 subunit
  ENST ID: ENST00000377328
  CDS Start-End: 1-1233
atggtccaaagggacatgtccaagtcgcctcccacagcggcggcggcggtggcgcaggagatccagatggaactgctagagaacgtggctcccgcgggggcgctcggagccgccgcacagtcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaagttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatga

SEQ ID NO: 113121 - DNA, 3396 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000377329
  CDS Start-End: 191-2011
ttgtgatccgacgaactttagaaagtcacactaactaagactacacaccccaagccagcaagaaaaaggaaagcagttgctatgctgttcagcaaagcaagacttggctgccttttagctagtcctgaattcttgctcctgtgaagaaaattcctgctggagtgctgggcgcacttggaattggtctagcatgcttgacagacgccttatagctcctcaaactaaatacattattcctgggggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctccc

SEQ ID NO: 113122 - DNA, 1827 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000377331
  CDS Start-End: 1-1827
atgaatcaggggagtggactggacctgctgaagatctcatatggaaaaggagccagaaggaaaaacagatttaaaggatctgatggaagcacgtcatctgatactacctcaaatagttttgttcgccagggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctggtgcaaaatctgcagatgaacaagaccagtggaaaactgcaggcttgttttggcggtttactacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatga

SEQ ID NO: 113123 - DNA, 4464 bp, Homo sapiens
  Payload ID: 2126
  Gene Symbol: CACNB2
  Gene Name: calcium channel, voltage-dependent, beta 2 subunit
  Uniprot ID: Q08289
  ENST ID: ENST00000396576
  CDS Start-End: 502-2319
cagcagcgtgctaagaagcagtcacataaacagcagcaggagtaggcctcctgcttttcaaaagcagagtactgcagggtcgcgaaatgcaagacactcagatgtttgaaaatctcccgagttgagaatggctactgtaaaagcgtcaccaagaaactctgacgatctggacagtcctaactctgtgttagcaatacttacttccggaaaattaatgctacttcttgtagatttttgcaaataggaaacccccttgaagaagatctcaaattacgccccccacccccaaaaaaagacaaacaggggagaacaaagttttggcatgcctgcaggaacggtggcttttttagaaactacctaggaggcagaagctaagtgatttgctcatgcctcttacctgggagtagaaggtgggaagaaatggaccgaggctgtgacgagaagacaaggcacagtgcagcttggtgaagccacacgctgactgcgttctgccccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgctatagacatagatgctactggcttagatgcagaagaaaatgatattccagcaaaccaccgctcccctaaacccagtgcaaacagtgtaacgtcaccccactccaaagagaaaagaatgcccttctttaagaagacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaaccttgcctattgttcctgttgtttgtttacctcccagttacctaccattcctccccaccaccgactccagcaggttcactgtctgtcagaacccagaagtgcttcttataaccaaagtttctgttcttcagaagaaatcagggcaaaatggggtgacttgaagtgaataaaatgttaagaatattatcctacataagacatgtacacagaaggggaaccttgaagacattatctccatgcctcaattacactgctgtaagaagcttacaatgtcatcatgtttaaggctaagaccttttccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccccgtctctactaaaaagataaaaaattagccaggtgtggtggtgcacacctgtaatcccagctacttgggaggctgaggcaggagaattgcttgaacccaggaggtggagcctgcagtaagccaagatcacaccactgtactccagcctgggtgacagagtgagactccatctccaaaaaag

SEQ ID NO: 113124 - DNA, 597 bp, Homo sapiens
  Payload ID: 2126
  Gene Symbol: CACNB2
  Gene Name: calcium channel, voltage-dependent, beta 2 subunit
  ENST ID: ENST00000612743
  CDS Start-End: 97-591
ctagcatgcttgacagacgccttatagctcctcaaactaaatacattattcctgggggttcggcagactcctacactagccgtccatccgattccgatgtatctctggaggaggaccgggaggcagtgcgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttg

SEQ ID NO: 113125 - DNA, 4385 bp, Homo sapiens
  Payload ID: 2126
  Gene Symbol: CACNB2
  Gene Name: calcium channel, voltage-dependent, beta 2 subunit
  ENST ID: ENST00000617363
  CDS Start-End: 502-2247
cagcagcgtgctaagaagcagtcacataaacagcagcaggagtaggcctcctgcttttcaaaagcagagtactgcagggtcgcgaaatgcaagacactcagatgtttgaaaatctcccgagttgagaatggctactgtaaaagcgtcaccaagaaactctgacgatctggacagtcctaactctgtgttagcaatacttacttccggaaaattaatgctacttcttgtagatttttgcaaataggaaacccccttgaagaagatctcaaattacgccccccacccccaaaaaaagacaaacaggggagaacaaagttttggcatgcctgcaggaacggtggcttttttagaaactacctaggaggcagaagctaagtgatttgctcatgcctcttacctgggagtagaaggtgggaagaaatggaccgaggctgtgacgagaagacaaggcacagtgcagcttggtgaagccacacgctgactgcgttctgccccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctggtgcaaaatctgcagatgaacaagaccagtggaaaactgcaggcttgttttggcggtttactacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaaccttgcctattgttcctgttgtttgtttacctcccagttacctaccattcctccccaccaccgactccagcaggttcactgtctgtcagaacccagaagtgcttcttataaccaaagtttctgttcttcagaagaaatcagggcaaaatggggtgacttgaagtgaataaaatgttaagaatattatcctacataagacatgtacacagaaggggaaccttgaagacattatctccatgcctcaattacactgctgtaagaagcttacaatgtcatcatgtttaaggctaagaccttttccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccccgtctctactaaaaagataaaaaattagccaggtgtggtggtgcacacctgtaatcccagctacttgggaggctgaggcaggagaattgcttgaacccaggaggtggagcctgcagtaagccaagatcacaccactgtactccagcctgggtgacagagtgagactccatctcc

SEQ ID NO: 113126 - DNA, 3707 bp, Homo sapiens
  Payload ID: 2126
  Gene Symbol: CACNB2
  Gene Name: calcium channel, voltage-dependent, beta 2 subunit
  ENST ID: ENST00000615785
  CDS Start-End: 502-1569
cagcagcgtgctaagaagcagtcacataaacagcagcaggagtaggcctcctgcttttcaaaagcagagtactgcagggtcgcgaaatgcaagacactcagatgtttgaaaatctcccgagttgagaatggctactgtaaaagcgtcaccaagaaactctgacgatctggacagtcctaactctgtgttagcaatacttacttccggaaaattaatgctacttcttgtagatttttgcaaataggaaacccccttgaagaagatctcaaattacgccccccacccccaaaaaaagacaaacaggggagaacaaagttttggcatgcctgcaggaacggtggcttttttagaaactacctaggaggcagaagctaagtgatttgctcatgcctcttacctgggagtagaaggtgggaagaaatggaccgaggctgtgacgagaagacaaggcacagtgcagcttggtgaagccacacgctgactgcgttctgccccctcttcatgcagtgctgcgggctggtgcatcgccggcgagtacgggtgtcctatggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaagttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaaccttgcctattgttcctgttgtttgtttacctcccagttacctaccattcctccccaccaccgactccagcaggttcactgtctgtcagaacccagaagtgcttcttataaccaaagtttctgttcttcagaagaaatcagggcaaaatggggtgacttgaagtgaataaaatgttaagaatattatcctacataagacatgtacacagaaggggaaccttgaagacattatctccatgcctcaattacactgctgtaagaagcttacaatgtcatcatgtttaaggctaagaccttttccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccccgtctctactaaaaagataaaaaattagccaggtgtggtggtgcacacctgtaatcccagctacttgggaggctgaggcaggagaattgcttgaacccaggaggtggagcctgcagtaagccaagatcacaccactgtactccagcctgggtgacagagtgagactccatctcc

SEQ ID NO: 113127 - DNA, 3825 bp, Homo sapiens
  Payload ID: 2126
  Gene Symbol: CACNB2
  Gene Name: calcium channel, voltage-dependent, beta 2 subunit
  ENST ID: ENST00000612134
  CDS Start-End: 1-531
atgcttgacagacgccttatagctcctcaaactaaatacattattcctgggggttcggcagactcctacactagccgtccatccgattccgatgtatctctggaggaggaccgggaggcagtgcgcagagaagcggagcggcaggcccaggcacagttggaaaaagcaaagacaaagcccgttgcatttgcggttcggacaaatgtcagctacagtgcggcccatgaagatgatgttccagtgcctggcatggccatctcattcgaagcaaaagattttctgcatgttaaggaaaaatttaacaatgactggtggatagggcgattggtaaaagaaggctgtgaaatcggattcattccaagcccagtcaaactagaaaacatgaggctgcagcatgaacagagagccaagcaagggaaattctactccagtaaatcaggaggaaattcatcatccagtttgggtgacatagtacctagttccagaaaatcaacacctccatcatctgacagagcacactcctccgtatgatgtggtaccttccatgcgaccagtggtcctagtgggcccttctctgaagggctacgaggtcacagatatgatgcaaaaagcgctgtttgattttttaaaacacagatttgaagggcggatatccatcacaagggtcaccgctgacatctcgcttgccaaacgctcggtattaaacaatcccagtaagcacgcaataatagaaagatccaacacaaggtcaagcttagcggaagttcagagtgaaatcgaaaggatttttgaacttgcaagaacattgcagttggtggtccttgacgcggatacaattaatcatccagctcaactcagtaaaacctccttggcccctattatagtatatgtaaagatttcttctcctaaggttttacaaaggttaataaaatctcgagggaaatctcaagctaaacacctcaacgtccagatggtagcagctgataaactggctcagtgtcctccagagctgttcgatgtgatcttggatgagaaccagcttgaggatgcctgtgagcaccttgccgactatctggaggcctactggaaggccacccatcctcccagcagtagcctccccaaccctctccttagccgtacattagccacttcaagtctgcctcttagccccaccctagcctctaattcacagggttctcaaggtgatcagaggactgatcgctccgctcctatccgttctgcttcccaagctgaagaagaacctagtgtggaaccagtcaagaaatcccagcaccgctcttcctcctcagccccacaccacaaccatcgcagtgggacaagtcgcggcctctccaggcaagagacatttgactcggaaacccaggagagtcgagactctgcctacgtagagccaaaggaagattattcccatgaccacgtggaccactatgcctcacaccgtgaccacaaccacagagacgagacccacgggagcagtgaccacagacacagggagtcccggcaccgttcccgggacgtggatcgagagcaggaccacaacgagtgcaacaagcagcgcagccgtcataaatccaaggatcgctactgtgaaaaggatggagaagtgatatcaaaaaaacggaatgaggctggggagtggaacagggatgtttacatccgccaatgagttttgcccgtttgtgtttttttttttttttttttgaagtcttgtataactaacagcatccccaaaacaaagtctttggggtctacactgcaatcatatgtgatctgtcttgtaatattttgtattattgctgttgcttgaatagcaatagcatggatagagtattgagatactttttcttttgtaagtgctacataaattggcctggtatggctgcagtcctccggttgcatactggactcttcaaaaactgttttgggtagctgccacttgaacaaaatctgttgccacccaggtgatgttagtgttttaagaaatgtagttgatgtatccaacaagccagaatcagcacagataaaaagtggaatttcttgtttctccagatttttaatacgttaatacgcaggcatctgatttgcatattcattcatggaccactgtttcttgcttgtacctctggctgactaaatttggggacagattcagtcttgccttacacaaaggggatcataaagttagaatctattttctatgtactagtactgtgtactgtatagacagtttgtaaatgttatttctgcaaacaaacaccttcttattatatatataatatatatatatatcagtttgatcacactattttagagtcttaatgccaagtcagcagatttgctttatgaattacagggactagaaatgcccacattcaggaaatttgtaataacattgtctagacacctatcctcattctagtagaaagtgtgtacatactgtaaatatgtgtgattgcttgacttgaaaaggtttgaattctgaatgttataccatccttgtaagtaagtttgtaatttccaccataaattatggtaaatataaaactccagaggttgttctactccatacagttcacactgattgtgacacattcttagtagctagtgtctgttctagtcactgcactggagtctacgagccggaactcgctatatgcacgtgtgtgtgtccgtatgtaagaaagtgtgcaccgagtgactgaatggttgagatgaattggaatgctgaagactaacgaagaaactagagactgatatcgagcattctgcccacctcgctctgtatttaattaattgtgctatatgttgctttaacaacccattgagcagtcagggaatgtgagtaagcttgctgccaaaggtaactaggaaagcattcatctgctgcctccttgtttttgctcctagagagtgaaaatacaggcaattttactgtgagtgtttcactggaaatgtacaatctttgtgtgttagagtatttgttttagtaagaaatgtttacacagcttgtggaattatttcgtgggaaaataaatttttataacttctcccacttcaatttctaaccttgcctattgttcctgttgtttgtttacctcccagttacctaccattcctccccaccaccgactccagcaggttcactgtctgtcagaacccagaagtgcttcttataaccaaagtttctgttcttcagaagaaatcagggcaaaatggggtgacttgaagtgaataaaatgttaagaatattatcctacataagacatgtacacagaaggggaaccttgaagacattatctccatgcctcaattacactgctgtaagaagcttacaatgtcatcatgtttaaggctaagaccttttccgtgtctcaagtgtatattttgtccagttataactggatggtaagacagtattaagagtgcaagtacctggcacttgaagtttgtcccaggaaaatgcctgtgtataattacctaacttcagatctgcacattaacttatttaacaaaataaatcagccgggcgcagtggctcatgcctgtaatcccagcaatttgggaggctgaggagggtggatcacctgaggtcaggagttcaagaccagcctggccaacgtggcgaaaccccgtctctactaaaaagataaaaaattagccaggtgtggtggtgcacacctgtaatcccagctacttgggaggctgaggcaggagaattgcttgaacccaggaggtggagcctgcagtaagccaagatcacaccactgtactccagcctgggtgacagagtgagactccatctcc

SEQ ID NO: 113128 - DNA, 2696 bp, Homo sapiens
  Payload ID: 2127
  Gene Symbol: CACNB3
  Gene Name: calcium channel, voltage-dependent, beta 3 subunit
  Uniprot ID: P54284
  ENST ID: ENST00000301050
  CDS Start-End: 200-1654
gtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 113129 - DNA, 1872 bp, Homo sapiens
  Payload ID: 2127
  Gene Symbol: CACNB3
  Gene Name: calcium channel, voltage-dependent, beta 3 subunit
  Uniprot ID: P54284
  ENST ID: ENST00000536187
  CDS Start-End: 101-1552
aggcgtgcaggcgggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagca

SEQ ID NO: 113130 - DNA, 1814 bp, Homo sapiens
  Payload ID: 2127
  Gene Symbol: CACNB3
  Gene Name: calcium channel, voltage-dependent, beta 3 subunit
  Uniprot ID: P54284
  ENST ID: ENST00000540990
  CDS Start-End: 98-1513
actgacccgaggagcggtcccgcgactctgtactccctgctgcccagtcccggccaggacgctgcccggcttagctggggcgcccctcgagaccaggatggagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctca

SEQ ID NO: 113131 - DNA, 2237 bp, Homo sapiens
  Payload ID: 2127
  Gene Symbol: CACNB3
  Gene Name: calcium channel, voltage-dependent, beta 3 subunit
  ENST ID: ENST00000547392
  CDS Start-End: 427-1800
tccccgccgccacggccccgtaggtgctcggggacccaccttccacctagcacgggttcgttcccctctcccggcctggcccgggctccccggtggccgccgccccctcgccgcccccgccttctcccggggagggggtcaggtgggcgggcactattgttgtaggagccggcgccagattcctcagccgcgctcggggtgggaccggctgggtttgggggggtggggtggggggagcggtgatctgagctccgagcagctggtcttcgcggctcgctccctccttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgaca

SEQ ID NO: 113132 - DNA, 581 bp, Homo sapiens
  Payload ID: 2127
  Gene Symbol: CACNB3
  Gene Name: calcium channel, voltage-dependent, beta 3 subunit
  ENST ID: ENST00000548874
  CDS Start-End: 97-414
gtgcaggcgggagcagcgtgcagagcagcggccgggttttgctcccgcctcggagcccctggcccgggggagggggagaggccgctagcctggtctatgtctttttctgactccagtgcaaccttcctgctgaacgagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagattt

SEQ ID NO: 113133 - DNA, 424 bp, Homo sapiens
  Payload ID: 2127
  Gene Symbol: CACNB3
  Gene Name: calcium channel, voltage-dependent, beta 3 subunit
  ENST ID: ENST00000550190
  CDS Start-End: 1-255
cagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 113134 - DNA, 2825 bp, Homo sapiens
  Payload ID: 2127
  Gene Symbol: CACNB3
  Gene Name: calcium channel, voltage-dependent, beta 3 subunit
  ENST ID: ENST00000551544
  CDS Start-End: 22-135
tcccccgacccggactcccccatgtatgacgactcctacgtgcccgggtttgaggactcggaggcgccccctgctgaggcttcctctgcagcgggcatcctgagctcttgcccagcatggagggcctggaggtgaggccagaggagctgagggcctggggatggagaggaagcgctttgctcagagaaacaggcaaccgataaatatttaattctcctctttgcttttatctcctgacccactgagacaaatcagctcattaagcagtgattcccggagctcagacagcagggagagtgcctggaaagatggggcaagaatgcggagcagcttctcagccccttggagctgacaactttccctcaaatgtcctggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 113135 - DNA, 746 bp, Homo sapiens
  Payload ID: 2127
  Gene Symbol: CACNB3
  Gene Name: calcium channel, voltage-dependent, beta 3 subunit
  ENST ID: ENST00000550064
  CDS Start-End: 582-746
cggatgccttggcactgtctggcacaatccttggcagggaagtggggaagggaacccccatcctggcaggactaagacaaaatctatccgtgcaacagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaat

SEQ ID NO: 113136 - DNA, 730 bp, Homo sapiens
  Payload ID: 2127
  Gene Symbol: CACNB3
  Gene Name: calcium channel, voltage-dependent, beta 3 subunit
  ENST ID: ENST00000550483
  CDS Start-End: 1-229
caaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattggcttcgatgaatgcccttttcctccaattccttcctgtccaccattcgggagccctcaaagcctgctggagtgagcagtgggcagagctcctggtgagcactgctgctgcctccctccatagcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaag

SEQ ID NO: 113137 - DNA, 904 bp, Homo sapiens
  Payload ID: 2127
  Gene Symbol: CACNB3
  Gene Name: calcium channel, voltage-dependent, beta 3 subunit
  ENST ID: ENST00000547818
  CDS Start-End: 539-904
gcagcctctcctccccttcctccccgccgccacggccccgtaggtgctcggggacccaccttccacctagcacggggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaag

SEQ ID NO: 113138 - DNA, 2395 bp, Homo sapiens
  Payload ID: 2127
  Gene Symbol: CACNB3
  Gene Name: calcium channel, voltage-dependent, beta 3 subunit
  Uniprot ID: P54284
  ENST ID: ENST00000547230
  CDS Start-End: 22-1353
tcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctagccaagcagaagcaaaagcaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgggcaagaggaccatcattgagcgctcctctgcccgctccagcattgcggaagtgcagagtgagatcgagcgcatatttgagctggccaaatccctgcagctagtagtgttggacgctgacaccatcaaccacccagcacagctggccaagacctcgctggcccccatcatcgtctttgtcaaagtgtcctcaccaaaggtactccagcgtctcattcgctcccgggggaagtcacagatgaagcacctgaccgtacagatgatggcatatgataagctggttcagtgcccaccggagtcatttgatgtgattctggatgagaaccagctggaggatgcctgtgagcacctggctgagtacctggaggtttactggcgggccacgcaccacccagcccctggccccggacttctgggtcctcccagtgccatccccggacttcagaaccagcagctgctgggggagcgtggcgaggagcactccccccttgagcgggacagcttgatgccctctgatgaggccagcgagagctcccgccaagcctggacaggatcttcacagcgtagctcccgccacctggaggaggactatgcagatgcctaccaggacctgtaccagcctcaccgccaacacacctcggggctgcctagtgctaacgggcatgacccccaagaccggcttctagcccaggactcagagcacaaccacagtgaccggaactggcagcgcaaccggccttggcccaaggatagctactgacagcctcctgctgccctaccctggcaggcacaggcgcagctggctggggggcccactccaggcagggtggcgttagactggcatcaggctggcactaggctcagcccccaaaaccccctgcccagccccagcttcagggctgcctgtggtcccaaggttctgggagaaacaggggaccccctcacctcctgggcagtgacccctactaggctcccattccaggtactagctgtgtgttctgcacccctggcaccttcctctcctcccacacaggaagctgccccactgggcagtgccctcaggccaggatccccttagcagggtccttcccaccagactcagggaagggatgccccattaaagtgacaaaagggtggggtgtgggcaccatggcatgaggaagaaacaaggtccctgagcaggcacaagtcctgacagtcaagggactgctttggcatccagggcctccagtcacctcactgccatacattagaaatgagacaatcaaagcccccccagggtggcacacccatctgtttgctggggtgtggcagccacatccaagactggagcagcaggctggccacgctcgggccagagagagctcacagctgaagctcttggagggaagggctctcctcaccctgccaggaagcttcttaacatgtgacaggaccagggaccaggagcatggtgaagccaagtggcagatgggagccaacctggatgggggtttggggaaggagggcatgtgtagcagagaacttaggggggcctccttgcctttctcattcttttgccctgcatcctgtcatttctgttcttgtccctcatacatctttggagaaccgggctccagactttgttccctgactcatagctgccgcttgttaggttagggttagatggggagagacagggcacagaggacctgtctccccggctactcttgccttatggctctagtgtgtgacctacagagcatgctccacaagcccctgcctcacctcactgtcatcactaataaacatcatgcacagtc

SEQ ID NO: 113139 - DNA, 754 bp, Homo sapiens
  Payload ID: 2127
  Gene Symbol: CACNB3
  Gene Name: calcium channel, voltage-dependent, beta 3 subunit
  ENST ID: ENST00000550391
  CDS Start-End: 117-572
agaaaggggcgggaggggtactgacccgaggagcggtcccgcgactctgtactccctgctgcccagtcccggccaggacgctgcccggcttagctggggcgcccctcgagaccaggatggagggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagaagtacagcaatgactggtggatcgggcggctagtgaaagagggcggggacatcgccttcatccccagcccccagcgcctggagagcatccggctcaaacaggagcagaaggccaggagatctgggaacccttccagcctgagtgacattggcaaccgacgctcccctccgccatctctaggcggaacatgttcccccatatgacgtggtgccctccatgcggcctgtggtgctggtgggaccctctctgaaaggttatgaggtcacagacatgatgcagaaggctctcttcgacttcctcaaacacagatttgatggcaggatctccatcacccgagtcacagccgacctctccctggcaaagcgatctgtgctcaacaatccgg

SEQ ID NO: 113140 - DNA, 576 bp, Homo sapiens
  Payload ID: 2127
  Gene Symbol: CACNB3
  Gene Name: calcium channel, voltage-dependent, beta 3 subunit
  ENST ID: ENST00000548279
  CDS Start-End: 144-576
cttcgcgctctctcgctccctgccgccgcccgcagggctgcggggctcggtggcatctcccgggcgcggcccgcagtccttgcccctgcctccgggccgctcccgcccccggcgccgctcgctcccccgacccggactcccccatgtatgacgactcctacgtgcccgggtttgaggactcggaggcgggttcagccgactcctacaccagccgcccatctctggactcagacgtctccctggaggaggaccgggagagtgcccggcgtgaagtagagagccaggctcagcagcagctcgaaagggccaagcacaaacctgtggcatttgcggtgaggaccaatgtcagctactgtggcgtactggatgaggagtgcccagtccagggctctggagtcaactttgaggccaaagattttctgcacattaaagagtacagcaatgactggtggatcgggcggctagtgaaagagggcggggacatcgccttcatccccagcccccagcgcctggagagcatccggctcaaacaggagcagaaggccaggagatctgggaacccttccagcctgagtg

SEQ ID NO: 113141 - DNA, 1394 bp, Homo sapiens
  Payload ID: 2128
  Gene Symbol: CACNB4
  Gene Name: calcium channel, voltage-dependent, beta 4 subunit
  Uniprot ID: O00305
  ENST ID: ENST00000201943
  CDS Start-End: 13-1389
cggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccaagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtcta

SEQ ID NO: 113142 - DNA, 1816 bp, Homo sapiens
  Payload ID: 2128
  Gene Symbol: CACNB4
  Gene Name: calcium channel, voltage-dependent, beta 4 subunit
  ENST ID: ENST00000360283
  CDS Start-End: 223-846
ctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccg

SEQ ID NO: 113143 - DNA, 2283 bp, Homo sapiens
  Payload ID: 2128
  Gene Symbol: CACNB4
  Gene Name: calcium channel, voltage-dependent, beta 4 subunit
  ENST ID: ENST00000397327
  CDS Start-End: 427-1848
gtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctgaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatc

SEQ ID NO: 113144 - DNA, 2053 bp, Homo sapiens
  Payload ID: 2128
  Gene Symbol: CACNB4
  Gene Name: calcium channel, voltage-dependent, beta 4 subunit
  ENST ID: ENST00000439467
  CDS Start-End: 1-1548
gctgcggtcctcaccggcttctctctggcccccgtgtgtcgagtccaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtattt

SEQ ID NO: 113145 - DNA, 583 bp, Homo sapiens
  Payload ID: 2128
  Gene Symbol: CACNB4
  Gene Name: calcium channel, voltage-dependent, beta 4 subunit
  ENST ID: ENST00000434468
  CDS Start-End: 258-583
agtagttgatggcgggtagtgctaggtactgcagtgctgtactcctggtgactcagtggtggccagcaggctgagatcctccgggctgtgcacatctgtggaggaagaataatgtgatgtgttacccaagatggtgtgaacagagcttcaagccaatggagaagactaggcctaaatagctgacctggtgaagtgacacataaagccacacctggagtgccacctcctcagcagtctttctcagtgccaatgcatttatggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcag

SEQ ID NO: 113146 - DNA, 1886 bp, Homo sapiens
  Payload ID: 2128
  Gene Symbol: CACNB4
  Gene Name: calcium channel, voltage-dependent, beta 4 subunit
  Uniprot ID: O00305
  ENST ID: ENST00000427385
  CDS Start-End: 73-1581
ccgctccggagcccgcagcctcccccagcggatgccggggactcggaccccgcaccctgagagtctttgttaatggatgtggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaa

SEQ ID NO: 113147 - DNA, 7974 bp, Homo sapiens
  Payload ID: 2128
  Gene Symbol: CACNB4
  Gene Name: calcium channel, voltage-dependent, beta 4 subunit
  Uniprot ID: O00305
  ENST ID: ENST00000539935
  CDS Start-End: 69-1631
agcccagcctcgggggccagccccctccgcccaccgcacacgggctggccatgcggcggctctgaacgatgtcctcctcctcctacgccaagaacgggaccgcggacgggccgcactcccccacctcgcaggtggcccgaggcaccacaacccggaggagcaggttgaaaagatccgatggcagcaccacttcgaccagcttcatcctcagacagggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatccagctttggtatttatttgctggaagctaaatttacacttaaagttggagtgtataaacattttaatatatgttaatgttgccagaatgacttttcagacttaccaaatgtattgatagtgccaaaaaaaaaatctcagaaatcttaatgcagaaattatatagtctcctcagattttaatatttttatttctttcctggcacagctgttgtattcaaagtgttttgctttttgtttggtcagtactgttagctcatttgaagttggcaaaaacaaatacaaacaagcaaaaaacctcaaatttttttcagcagtgagagagaatagtaaagagaggcccaagcatagctggttatgtgaaatataaaatggggtgttgttctccctttaatcaatctgagcacaactacatacatccaggaatctgaagtcagatagtaaggatgtggtaccaatcctcccgagtgcaatgctaaacacttccaggtgggaattcatctatttcacttaacacaaacgcagggtctgtatttcctgccaacaagattgagtatctttccattgcttctctcagtctctgtctttgaatatctgaatgttctggcccttcaacaaattctttaaatcatgctaaggaatttcgttttatgtggacacactcaactttgatattcaggagatgtttttacaaaatgactaattgaaaaaagttgaaacaaatgattttaaaagcttgcagtaaaaaataaactcatagattcagcaaatatttgttgactaaaattatagcatttttaatgcagaaaattataaagaatttggagattgagctgccttatttctaatgaacactcctcttcatcttattaagtcttcacagtttttccagtggctataattatggaattggtgacctatgttttatattatcaaggaagccttagattcactctgatctaagaaattattgaaattgaccctttttacacaaatgtctttaaaaaaaaaaacttatttctaaatgtccatagtgcatgcattttctaaaaccccaataagtccagccataaaagttcttttctgctagtacatgtcatgaagcctatttttgaaaataatgataattaattttatagtatcttcttttctccccaagcctttcagtattcaggcactcaaagcatgcaccagttcagtaatcttcttgaccatggaaataagttccacattactgatgagttatatatatatcttgaaccccattacaacctcaccacatccccctgcatttatgttcagtgtttgtaccccattatgaacctgtttagctgataatgaggatacctataattctgtaagtcatttcaaatatttgatacaattaaaaaatatgggcttagtaaattttaaaagttaacatgtgatactggcttgtgagattcttctgtcatctagtgaagcttataaaactttcagttaagacattttaaaagagttatatccattaggcactttaataaacatataacctgccattactgaatactttgttagaacacagaagagcatcttccagcaaacaaaaatatatttattacatgtacagcacatacttgcatgagaaagaaaacattagccaaaacatttttctatatgctttactggtttcttgtttatgcgcattaaagtatttaattgcaaagagtgcaccaaggtgtacaaatttagactagacagctgttcagctttttctgtagtagcattagcagtttggtcatttaactactttaagatacttacattttatggcaggtagctgtaacagcatttaaatatatttcctagtcatcaagattaccatcttctttcaactttttaaaagtcacttgtttttaaaggtttttcaaagccttgtttttagtcttccatgtcatgccgataaagagagtctcattcaatatctgtgcacaaaaccaatctatcaattaccatcagatgtccatacctgttttgctttgcattcttattcaaaagctgacaatcttggaaagggtataatgtatattttattgatggatatatttaaatgtttactttaatttggaatattctttccccttctttctgtaataagtttatcttcctcaaataaggggatatacatcttattttttttaaagacttaagagtttattgtgtaaatgatacttaaaatctagatatatactaaatgaaaagttttatttttgccaagcacaccaagcacctttgaaaaatacatactccatactttgtttttaattaatttcatttaaagatagcaaatgattataagcaagagaaacaagtcttttactgttttgaggctgttttaacttacagtataagccacatactagaattctgtaatttcagtcacagacatataataatgtggactcatgtgacaatgtggaaatgtagttctggaaaaaaacgaatgcaatttgtcaatcctgatgttaattctcaagggtataatgtcactctaatattataaccaacaacattatcttgtttaatatttaaagcaacacttagaaatgtttataaatgatgattctctcttatctttatacagttctattggagagaaggttgaaattgttcacaatttagatgatggtctttcctaataagagtcttaattttgtgactatataagtcattgcagttagtctttaatgaaatgaattttattaatgtaaaacaaattctgagacaattatttgtttcctttaaataatctgctatttaattattattgtcgttgtttgcaaaatgtatttttggaatgttaacctcttttcatacctgcatacttgaacttgtcttttgtgtgggggccttaaaattcataataggaagtggaggcagtgaaaggaagtaagaaaaggaaattatgctaaaagatggtttgcaaatttaaattctttaaatgaacatatcacaaaatgttgttaagacccaggatgtccgttaagaatgtgtcttggcaaccttaatttgcatgttagtatatattttcttagttacacagttttattttggtatttgcttaaaaaatgtaataccattgtagaaattaccctatgtactgatatatttactacctcttctctagagaagacaatctgtctttaaagggaaaaacactggtcaataagtagtgatcaaaattatcactattctggctaaccttgctgcaaagctaaatacatagattattaaaatatgccttccctttagattttaaactgtttccaaaatgctgtttggcaccctttcatttcttccacgttagtgaagttttctttgaattggttcacagtttatcatgaggcaaggttaatttaacaaataagtcatcatagggaacaaaacaaactgcaagggaattgcctttgtgtgcaacttgttataatatctagttctaagtctaaaggagtaaaagtccaaagactttatgtttaagagcagctggtttgcaaattcacattttgttggtccttgacttccacagagcatgacttagccatttactgggtaaggatatgcataatcttggactcccatgtaattggaataaacttcatatcaatgtttcaaataaatgctatgtaccccttattccttttacatttctgcctttgtcttttatgacaatgttgcatgttgtgtttttttaaattatataaaactcatccttgaatgactgtatgaatgaaaaatttataggaaattatgtaataaaatctgttttattagtttctcatacctttaaatactgtcaatactataactgttagtaagttacttactcaagctgtgtctatggggcagagaacagtcctcttctttaaaataatcatgatcaaaccagtcaagtcaatccaattagctgttagacagacaataaggataaccttctttttgacttaagcagtcaagttagtcaaaatagaaaaattggcttatatgggcacccagaactacagcattcaaaaattacttttaaaagtttcttcttttattaaaatggactttcttaaataaaatacatcctctgatagcagctatctctttttacttgtaatgattaattctaaatgcttcatgtaattgagggacattatgagaagactagaaagtatctcatcagataatcctaagggctgtaacttctacttgccataaacaaagtataattaagagtgagtagcaattggtttggggagtcgtagttatatatgaaactttcttttgtttctcatgatgtatgtaaaatgtttgcagaaggatggtagaaaatgttactaatgaatttagagtggtttgggagaatacactgatacttcctcatttgaaaattataaggagttacaaggggaactaagaaccagaagtggctggcctctagcttttcaatacctgataagtgttcttggttatgttttgaacacttaaatttctcaacaaatggctatgtctatatttatgtaggggccacccttgccctacttgcatgccactttgacttttaactgaaatcagtgtgaattctgtatgcataagggatgtaataaagaggcgggatcattaacgctatatcgttgcatactatttttcatatgccttacaatattttctgggatgttattaaaatgaaagcattttattgccaaaataaatctatgttgttacttataatctgcattagcagtagaaaaataatgtagcaaaaacatattgtacagtacaaaattataaaatatatattttgccaataatataaaaatagattgaggagaaagaagcacatttgttatagcacaaacttataacaaaatccaccgttaaatttggcagtcatattttttaaaagtatgtcgatttagttctaagttttgtcagatttacttcatctaccatctttttaacttgctgcttgatacttttccagcaatttatttcatagccttgcaatctgtggatgtaatttcttttgttttattcccttccataaaatttattaaattttattttgtgataacactcataccatattttctcctcttatttcttctctttcaataacaacagcagaaagtcacagcaagtgagctcatagggctcctctgaattttggacatgtgtgagatttttgtatttttcacagcctcgagtcagaatgatcaataaagatgtcccaaccacaaaaaattatattagttagggattctttaatttgttttgtactgaatactactttgaaacataagttaaagccattagctgtgtttttgtagggatggtgggaaggaataaaaaataaatgtattaacataaaacatactaaaacagaaatatggcaaaatgatgtaaaaagatttttcctactattctgagggctgttgaaatcccaggctattgctatatctccattgacaaagtgggataaaaaatgcctttgtcaaataattttttttctttctttaaattttagttatttattttaataatttgtccccttttatttttcttatctaggtatgtgtagcattctacaaggcatgctgggtaaaatatactatgcaaatgtgtacagtgctgcatgttttgttctccctctgctttagtggctttaaagaaaaaaacgtggtgttatttttgtgaataaaaacattaacaaagaaaatgcagagtgcatgcatagagtatcctcatttctatggatttgttttatggaatttaaatgtgtacaaaacaactgcattactttttttcttttatataataaatgaaaaaaacac

SEQ ID NO: 113148 - DNA, 2181 bp, Homo sapiens
  Payload ID: 2128
  Gene Symbol: CACNB4
  Gene Name: calcium channel, voltage-dependent, beta 4 subunit
  Uniprot ID: O00305
  ENST ID: ENST00000534999
  CDS Start-End: 228-1688
gtgctctgtattgggaaggcagataaaatgccaggtctggactgcctctggggataacctcaccctgtgggatgtgaatgaatagcatcttgcctggtaaatccacaggaattgataaggcaggcgcagttctcccaaacaggccttttctctttaagctgtagctgtggtttctgcagcaattttgtttttgccttgaaagaggtgctctggattatcacacctccatgtatgacaatttgtacctgcatggaattgaagactcggaggctggttcagcggattcctacacaagcaggccgtctgactccgatgtctctttggaagaggaccgggaagcaattcgacaggagagagaacagcaagcagctatccagcttgagagagcaaagtccaaacctgtagcatttgccgtgaagacaaatgtgagctactgcggcgccctggacgaggatgtgcctgttccaagcacagctatctcctttgatgctaaagactttctacatattaaagagaaatataacaatgattggtggataggaaggctggtgaaagagggctgtgaaattggcttcattccaagtccactcagattggagaacatacggatccagcaagaacaaaaaagaggacgttttcacggagggaaatcaagtggaaattcttcttcaagtcttggagaaatggtatctgggacattccgagcaactcccacatcaacagcaaaacagaagcaaaaagtgacggagcacattcctccttacgatgttgtaccgtcaatgcgtccggtggtgttagtggggccgtcactgaaaggttacgaggtaacagacatgatgcagaaagccctctttgatttcctgaagcacaggtttgatgggaggatttcaataacgagagtgacagctgacatttctcttgctaagaggtctgtcctaaataatcccagcaagagagcaataattgaacgttcgaacacccggtccagcttagcggaagtacaaagtgaaattgaaagaatctttgagttggcaagatctttgcaactggttgttcttgatgcagacaccatcaatcacccagcacaacttataaagacttccttagcaccaattattgttcatgtaaaagtctcatctccaaaggttttacagcggttgattaaatctagaggaaagtcacaaagtaaacacttgaatgttcaactggtggcagctgataaacttgcacaatgccccccagaaatgtttgatgttatattggatgaaaatcagcttgaggatgcatgtgaacatctaggggagtacctggaggcgtactggcgtgccacccacacaaccagtagcacacccatgaccccgctgctgggaaggaatttgggctccacggcactctcaccatatcccacagcaatttctgggttacagagtcagcgaatgaggcacagcaaccactccacagagaactctccaattgaaagacgaagtctaatgacctctgatgaaaattatcacaatgaaagggctcggaagagtaggaaccgcttgtcttccagttctcagcatagccgagatcattaccctcttgtggaagaagattaccctgactcataccaggacacttacaaaccccataggaaccgaggatcacctgggggatatagccatgactcccgacataggctttgagtctaatgaaacaaaaaatattcatctgttgacaatttgccatagcagtgctaggataaaccaatcatcttaacttggctaacatagcacagtatttactgtgctaatgggctgctgtcattttatgctaagtaaggggcaaaaaaaaaaattacattatgcccttgagtctagatggatattagatgcccgatcatatagatatttttaagtgcaacatttacatgataacagtacattttgttttcttcatagatttagacacatcaatttgtaatttagggtacttacaaggcacatataaaataatttcccatgctggaaattccaaatgaccagttccagttggaaccaatttataaaccaattcctgttggaatttgggtgaattgactagaaagtctacttgagcatgttgtaatcaactgaaaaatctggggggaaaaaaaaaaaactaataagaaaatcgaaataccaatagaagccaaatcca

SEQ ID NO: 113149 - DNA, 834 bp, Homo sapiens
  Payload ID: 2129
  Gene Symbol: CBARP
  Gene Name: calcium channel, voltage-dependent, beta subunit associated regulatory protein
  ENST ID: ENST00000215376
  CDS Start-End: 87-431
cgcgagcgccacgcagccgcccgccgccagcccgccgcccatgggccgctcgtcccggcgctgagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaaggcgtaggtgggcccaggcgcgtgctgagcgagtgagtgtgtgagcggatggacgagtgtccctcgccccgccagcccggccgcccgtgccgcggccccagccctccctgccgtggccgcccggaggagcagccctcccgggaccaggcgcctggcgtggcccgcccggggcccaccctctcctgcctctccacgcagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtg

SEQ ID NO: 113150 - DNA, 2453 bp, Homo sapiens
  Payload ID: 2129
  Gene Symbol: CBARP
  Gene Name: calcium channel, voltage-dependent, beta subunit associated regulatory protein
  Uniprot ID: Q8N350
  ENST ID: ENST00000382477
  CDS Start-End: 276-2453
gcgcagcgggggcggcgggccggggaccgggcagcaccgggcgcgcggagcgggcgcgccgccaacgcggtcacgtgcgcggcccctcctctcgcgccggcctcccccgcgccgcgctctccattcataaattctccgcctgctccgcggccaccgggcgccggagccagccgcgagcgccacgcagccgcccgccgccagcccgccgcccatgggccgctcgtcccggcgctgagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggccggcagggtggatggcagagcacggcagctggggcatcgggcatgggaggtgggcgggctctgatggccagatgctgtcgcaggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccagcccccggggaaggccctcaccggccgctctgtgggccccagctccgccctgccaggtgacccctacaactcagccgcgggcgccactgacttcgcagagatcagcccctcggcatctagcgactctggggaaggcacctcgttggatgccggtaccaggagcaccaaggctggagggcccggggctgcagcagggcctggggaggcgggcccgggatccggggcaggtaccgttctgcagttcctcacccgcctgcgccgccatgccagcctggatggggccagcccctatttcaaggtcaagaagtggaagctggagcccagccagcgggcagccagtctggacacgagaggttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgcctcggaccacagcagcagcggcaacgaccgcgactcggtgcgcagcggcgacagctcgggctcaggctccgggggcgcggcgcccgccttcccgccgccctccccgcccgcgccgcggcccaaggacggcgaggcgcgccggctgctgcagatggacagtggctacgccagcatcgagggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaa

SEQ ID NO: 113151 - DNA, 929 bp, Homo sapiens
  Payload ID: 2129
  Gene Symbol: CBARP
  Gene Name: calcium channel, voltage-dependent, beta subunit associated regulatory protein
  ENST ID: ENST00000589260
  CDS Start-End: 113-262
cgcggccaccgggcgccggagccagccgcgagcgccacgcagccgcccgccgccagcccgccgcccatgggccgctcgtcccggcgctgagggccctcctccccagttcagaatgcagcccacagccaccatggccacagccgccaccaccaccaccaccaccactgccacagtagccctgacgacgtcgtgggacaatgccactggacgccccacgagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaaggcgtaggtgggcccaggcgcgtgctgagcgagtgagtgtgtgagcggatggacgagtgtccctcgccccgccagcccggccgcccgtgccgcggccccagccctccctgccgtggccgcccggaggagcagccctcccgggaccaggcgcctggcgtggcccgcccggggcccaccctctcctgcctctccacgcagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttc

SEQ ID NO: 113152 - DNA, 4261 bp, Homo sapiens
  Payload ID: 2129
  Gene Symbol: CBARP
  Gene Name: calcium channel, voltage-dependent, beta subunit associated regulatory protein
  ENST ID: ENST00000590083
  CDS Start-End: 294-1655
ggtggccggcgcggagccagccagacccagcggcgagcgcagcgggggcggcgggccggggaccgggcagcaccgggcgcgcggagcgggcgcgccgccaacgcggtcacgtgcgcggcccctcctctcgcgccggcctcccccgcgccgcgctctccattcataaattctccgcctgctccgcggccaccgggcgccggagccagccgcgagcgccacgcagccgcccgccgccagcccgccgcccatgggccgctcgtcccggcgctgagggccctcctccccagttcagaatgcagcccacagccaccatggccacagccgccaccaccaccaccaccaccactgccacagtagccctgacgacgtcgtgggacaatgccactggacgccccacggcagagccagaccccatcctggacaactacgtgctgctggtggtggtgatgtcgctgttcgtggggggcacgctggtggtgttgtctggcgtcctgctcctctgcaagcgctgctgggacgtccaccagcgcctcaacagggccatggaggaagcggagaagaccaccaccacctacctggacaacggcacccacccagcccaagaccccgacttccggggagaggaccccgagtgccaggatgcggagaccgaacgcttcctgtccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccagcccccggggaaggccctcaccggccgctctgtgggccccagctccgccctgccaggtgacccctacaactcagccgcgggcgccactgacttcgcagagatcagcccctcggcatctagcgactctggggaaggcacctcgttggatgccggtaccaggagcaccaaggctggagggcccggggctgcagcagggcctggggaggcgggcccgggatccggggcaggtaccgttctgcagttcctcacccgcctgcgccgccatgccagcctggatggggccagcccctatttcaaggtcaagaagtggaagctggagcccagccagcgggcagccagtctggacacgagaggttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcaggtatttttcagtagatggaggtgctaggggtggacctgtgggcccttgccccccttcgcccccccctaggcggcccagggagcgctctccaggccccgtggacacgcgctcgcctgcctccagcggcaaggcccctcccagaggcggactcactggggccacctctccagcatggaccagaggagggaagcagggagagactgggtaagggtagggcggtgggtggggaggaggggccccccgaggatggcgctggtactgctgcttgctggtggagtccgaggcctgaagggttctgctgtggtcccaggccctctcccacccccgccccgcccatgctcccaaggctgggcagactcctctcagaagctgctgtgaccactccggccagcagcacccctcccccaacccaagggcaacttccctgaagcccagggcccacgtcggtgggatgggaatggggcgtggggctggggcagagcagggttcctggggcagccctggtatggcgggtgaccctcacgtctgtgcactgtcctcctgctggttatccagcatgggtgggcagagagccctagcctggagcaggggctgagctggactcaaccgcgtccagtccatcccctgcggctcccacgtccactgggaggctgggaaaacgtgactcccggagagaagcatgttgacttttcctgggggcttccaagggagggggccccgccgtctgcagtccagcatggaggcaccctgcttaataagcaggcgccacagctcagggtcaatgcaagacgcatcccctgcaaaacacactggctcattttaaagctctcaccttccaaggcccgcccgagtcccaagtcccacccgcgtccaccctccctgatccagaggcgggatggccggccgggtagggggcgcggggctcggcggggctctgacggcgcggcctggcttgcaggctagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgcctcggaccacagcagcagcggcaacgaccgcgactcggtgcgcagcggcgacagctcgggctcaggctccgggggcgcggcgcccgccttcccgccgccctccccgcccgcgccgcggcccaaggacggcgaggcgcgccggctgctgcagatggacagtggctacgccagcatcgagggccgcggcgcaggcgacgacaccgagccacctgccgcgcccgcccggccccgcagcccgcgcgcctggccccgccgcccgcgccgcgactacagcatcgacgagaagacggacgcgctgttccacgagttcctgcgccacgacccgcacttcgacgacacgccggctgccgcgcgacaccgcgcccgcgcgcacccgcacgcccgcaaacagtggcagcgtggccggcagcacagcgaccccggcgcccgcgcggccccggccctggccggaaccccggcaccgcctgccggcgcggcccgacccgcgcgtgcgcccttgcggcgcggcgacagcgtggacggcccgcccgacggtcgcaccctgggcggcgccggcgacgaccccgccatccccgtcatcgaggaggagccgggcggcggggggtgccccggctcgggcctgtgcgtcctaccatccgggtcggtgctggacaagctggcggctggcctcgacgagagactctttccgccgcgcctcgccgagcccgtcgtggcgactcccgcgttggtcgccgccgcccccacgtcccccgaccacagcccggcctaagtcccgcgtcctgggcccatctctctggcagcttctccggcgccgcacggggcctcggcggcgggagagacgtgggggcgcgacgccccgacgcgaatgcgcggggaccgcgggcccttcgcgcacgcgccgggcgacggaggcgcgctcgccgcttcagggcgcaggcgcagagccccggccgccctcgcgccgccgaagtgtgcactgctctttccggtgcttgccgggtgctgggcgtcgtgaggcgcgggccgcggagaccccggctgggcgggaaggaaggggcgtgaacggctctcagcttcgggctcctgaggacaacgatcactcgccctcagtcccggacggggcggccgcttagtcgcagggcccgccacccgagggtcgcgcagcccactgggcccgatggagccgccgcgtgccgggcgcgtgcgcgagctcgcccgggcgggggccgcggggcgctaacggtcgcagacgagttcgccgccctgggccgggaggcggctcaacaccgtgactgccgacctccgagaccgtttacctcactgcggcgtgtgctggcggcagcccgcgccgcctccgagcaataaccgcgccgccaccgctgctgccgccggccctgagggagccggccccggccctcccgcgccccgagtccccactgccctccgcatgtcaacggcgcccgccccgctgccgccccatccacgttgagacgcgaacaaaacccagacggccaggtccaagcttcccaagctttatttattgccaaatttgggcggcctcgcccgcacggcaccctccgagtccccgccgcgtctgcaccatcccgcgatggcgtttctcgtgtttttcttttctggatgatataaatattgaccgcaca

SEQ ID NO: 113153 - DNA, 933 bp, Homo sapiens
  Payload ID: 2129
  Gene Symbol: CBARP
  Gene Name: calcium channel, voltage-dependent, beta subunit associated regulatory protein
  ENST ID: ENST00000591127
  CDS Start-End: 1-275
ccaccagctccacgggccgccgggtctccttcaatgaggcggcgctgtttgagcagagccgcaagacgcaggacaagggtcgccggtacacactgacggagggggacttccaccacctgaagaatgcccggctcacgcacctgcacctgccgcccctcaagattgtcaccatccacgagtgtgactcaggcgaggccagctcagccaccacgccccacccggccacctctcccaaggccactctggccatcttccagctccgccctgccaggtgacccctacaactcagccgcgggcgccactgacttcgcagagatcagcccctcggcatctagcgactctggggaaggcacctcgttggatgccggtaccaggagcaccaaggctggagggcccggggctgcagcagggcctggggaggcgggcccgggatccggggcaggtaccgttctgcagttcctcacccgcctgcgccgccatgccagcctggatggggccagcccctatttcaaggtcaagaagtggaagctggagcccagccagcgggcagccagtctggacacgagaggttcccccaagcggcaccacttccagcggcagcgggcagccagtgagagcacggagcaggaggagggggatgccccccaggaggacttcatccagtacattgcccgggcgggcgacgccgtggccttcccgcacccccgcccctttctggccagcccgccccctgctctcggcagaggcggccgaggcagcgggaggagcgagccccgattcccccccggagcgcggcgcgggcagcgcggggcctgagcagcagcagccgccactggagccggacgccgagcgggacgcgggccccgagcaggcccagaccagctaccgcgacctgtggagcctgcgcgcctcgcttgagctgcatgcggccgc

SEQ ID NO: 113154 - DNA, 1266 bp, Homo sapiens
  Payload ID: 2130
  Gene Symbol: CACNG1
  Gene Name: calcium channel, voltage-dependent, gamma subunit 1
  Uniprot ID: Q06432
  ENST ID: ENST00000226021
  CDS Start-End: 72-740
cggcttgtcacctgccctaggagacgcagccgccggaccctgcccagggcacccacgcctcggcgaccaccatgtcccagaccaaaatgctgaaggtccgcgtgaccctcttctgcatcctggcaggcatcgtgctggccatgacagccgtggtaaccgaccactgggctgtgctgagcccccacatggagcaccacaacactacctgcgaggcggcccacttcggcctctggcggatttgtaccaagcgcatccccatggacgacagcaagacctgcgggcccatcaccctgcccggggagaagaactgttcctacttcaggcattttaaccccggcgagagctcggagatcttcgaattcaccactcagaaggagtacagcatctcggcagccgccatcgccatcttcagccttggcttcatcatcctgggcagcctctgtgtcctcctgtccctcgggaagaagagggactatctgctgcgacccgcgtccatgttctatgcctttgcaggtctctgcatcctcgtctcggtggaggtcatgcggcagtcggtgaagcgcatgattgacagtgaggacaccgtctggatcgagtactattactcctggtcctttgcctgcgcctgtgccgccttcatcctcctctttctcggcggtctcgccctcctgctgttctccctgcctcgaatgccccggaacccatgggagtcctgcatggatgctgagcccgagcactaaccctcctgcggccctagcgaccctcaggcttcttccccaggaagcggggtcttggcctggaaccttccagagaggaggcgggagcaattttagccccaccctgctcccatctgcccccctgcaacagtcgcaggctgcttcctctctctgagttcctctgggctgccgcaggctcccctgggaatagagcaagacgtgagtcctaacctggccacagttgggggaggcagagccagcaggtggacaggtgtttgcaggggcccaacttcccctggagctcagaggtgtccccactgtaccagcctctgataagctgcctccagttgtcctttatgaacattgcagggacaacctgtgtttgccagctgggtgttccgtgtaaatagccagcctgtctctttctcggtgataaaacacaccctctctggtgagcccagcgtcccctccttggcttccaggagccctgggaagcatttttaactgggtagaatctgactgtggcttgaaataaaaagctctcagaaaa

SEQ ID NO: 113155 - DNA, 2384 bp, Homo sapiens
  Payload ID: 2131
  Gene Symbol: CACNG2
  Gene Name: calcium channel, voltage-dependent, gamma subunit 2
  Uniprot ID: Q9Y698
  ENST ID: ENST00000300105
  CDS Start-End: 983-1954
gcggcgcagggagctgtccggttcagcaccacccgtaatgcagtaggtgggagcgcctccgcgggcgcccagccggtagcgagtggggggcaggcgcgcggcccaccctgcagcaagacgccggctccctcgtttccaggagctttgcagatagggggagggaaatccgcctcgattctccaggagaaaccccctctctcccccacttcgccaacactacccccgccaccaacaacaataaccgccgccgctgctcgtcctgctgccgccgccgccgccgcgcctgcccgccctgccgccgccgccgccgccgccgccgctgcccgggcaaaaccatggaaagcgagacccccgcacctgtgcagctgagctcaagggcttacagaatactgggaagtctggtctgaaacgaaagcgccgagaccccccaaggaagagaactggcgaagcaaaggattttcatggcgcaggccgcagagccgagaacgaagaccgaaggttgcatctcggctctcacagtctctaactgtctaggtcccgaccatgagaaatggtgttgagaattcggctgttccctggttcactgtggaagccatctccaaattaactatcacatatggaaactggagaccagaattttagaaaaagagattaaggcatctcacttgggggggtggggggtgtctttttattttttttttccttttctttttaaaaaaaaaacactgcaactggaacagtttctgatctcaaaaggcaagcctcttcccgtgtgatctttataatttacactcttttccgtgagctttcttacctccctttttttataactctccatattctctattcatacatatatccattatattagtagtggaataatttttatttttatttattttttttggctttagtacttgcaccctcacacacactctcccgagaaccagaagtcggttgggtgtttatataatgaagaattatggggctgtttgatcgaggtgttcaaatgcttttaaccaccgttggtgctttcgctgccttcagcctgatgaccatagctgtgggaaccgactattggctctactccagaggggtttgcaagaccaaaagtgtcagtgagaatgaaaccagcaaaaagaacgaggaagttatgacccattccggattatggagaacctgctgcctagaagggaatttcaaaggtctgtgcaagcaaattgatcacttcccagaggatgcagattacgaagctgacacagcagaatatttcctccgggccgtgagggcctccagcattttcccaatcctgagtgtgattctgcttttcatgggtggcctctgcatcgcagccagcgagttctacaaaactcgacacaacatcatcctgagtgccggcatcttcttcgtgtctgcaggtctgagtaacatcattggcatcatagtgtacatatctgccaatgccggagacccctccaagagcgactccaaaaagaatagttactcatacggctggtccttctacttcggggccctgtccttcatcatcgccgagatggtcggggtgctggcggtgcacatgtttatcgaccggcacaaacagctgcgggccacggcccgcgccacggactacctccaggcctctgccatcacccgcatccccagctaccgctaccgctaccagcgccgcagccgctccagctcgcgctccacggagccctcacactccagggacgcctcccccgtgggcatcaagggcttcaacaccctgccgtccacggagatctccatgtacacgctcagcagggaccccctgaaggccgccaccacgcccaccgccacctacaactccgacagggataacagcttcctccaggttcacaactgtatccagaaggagaacaaggactctctccactccaacacagccaaccgccggaccacccccgtataaagaccgcgggcctcgccagaagaccgcgggaggagggcgcggtccccgggggcggggcggggcggggagacccagaccctccgctgggagaccttccaaaagcaaaaacaaaaaacaaaaaaaacaaaaaaacaaaaaacaaaaaaacacacacacacaaaaaaagagaaaaaacataacaagtaaattttaaaaaaaagaacaaaatataagaggaacaaagaagcaaaacaacaggaaatgtgggaaaatataaacgagggaagaaaacaaactttaaaaaaaagcgagagggataaaaaattaaaaatagaaaataaatctaaaagaaaatgcatgatttcccatgtaccattattttaacatttaataaaaatcaatttaaatgaaaaaataaaagggaaccaagataacattaaagcaaaaaaaa

SEQ ID NO: 113156 - DNA, 3088 bp, Homo sapiens
  Payload ID: 2132
  Gene Symbol: CACNG3
  Gene Name: calcium channel, voltage-dependent, gamma subunit 3
  Uniprot ID: O60359
  ENST ID: ENST00000005284
  CDS Start-End: 1203-2150
actttttgcccgcctaagcgagccatagagccgtctccagagctgccggtgcctttaagaagactcggtctttcgggtcttctttttccccaatgggctccagtggtgcccgcagcaaaaggcaaacttgcctggctcatggggtgaaagggaggattgaagaatgccgcgttgggtgggtgctgagggagcgccagagtgcgctacgggcttcgctccccttcccctttccttaacccttcctagagcggaggaaccgggtcgtgctgcagcgcccaggagccagggcgctgactgtcctcggctccagaaactttgcgcggagagtgggcttgactgggcagagccgagccggctggctgacccgggaaggaacgggggaagggcggggtgagggaagaaagaccctttagcaccccgggtttctagcccgggcggcggtgtgcagctgcatgagggagctgtcccttcggcaccacggaccttaaagcctaggcgttaagacgacggaggcggggcaacaggcggggagctgtcccttcagcaccacggaccttggcgcccccagggaaaccagccggcccccgccccaggactctgtcttttctccagtttgagcgggggtgtcgggagcaggcggagagctttcctgcgaggctgtggaagcagtgaacactcttctcagcggctcgcctcccagcagtgctattttttgccatccgccctcacccccagcacacgcgctcgcacacacacgcacgcacgcacacacacacacacacacactcacacagagacctctctgggtttctttgccttgagtctcccggggctgtgagaagccaggcgcatctcaaaccgagctggcagctccaggctccggagccatgccctgcacggaccctcgtctttaccacgctcctgaggaatgaaaggaacccagggaccctcagaaggcagcagtgatgcggaccaaccccccggagcctgcacccttccgagggccataggcgacccagggaactggagagagctccagaaaggaaatcccagctttcccaaagtccctgtggatgctgacaaaaggagacctgaatttttggaagagcctgtactaggttacccggctgcagagtgattttcccctccggcactgactctccccctccaacccccagccgtccagagtaccatgaagaattatgaggatgtgtgacagaggtatccagatgttgatcaccactgtaggagcctttgccgcttttagtttaatgaccattgcagtgggcacggactactggttatattccagaggtgtgtgcaggactaaatctacaagtgataatgaaaccagcaggaagaatgaagaagtaatgacccattcggggctgtggaggacctgctgcctagaaggggctttccgaggcgtgtgcaagaaaatcgatcacttccctgaagatgctgactacgaacaggacacagccgaatatctcctgcgagctgtgagggcctccagtgtcttccccatcctcagtgtcacgctgctgttcttcggcgggctctgcgtggcagccagtgagttccaccgcagcagacacaacgtcattctcagcgcgggcatcttttttgtctctgcagggttaagcaacatcattggcatcatagtttatatatcagccaacgccggagaccccgggcagcgtgactccaaaaaaagttactcctatggttggtccttttatttcggagccttctctttcatcatcgcagaaattgtaggagtggttgccgtgcacatctatattgaaaaacatcagcagttacgagccaaatcccactcggagttcctgaagaaatctacttttgcccgcctcccaccctacaggtatcgattccggaggcggtcaagttctcgctccaccgagcccagatcccgagacctgtcccccatcagcaaaggcttccacaccatcccttccactgacatctcgatgttcaccctctcccgggacccctcaaagatcaccatggggaccctcctcaactccgaccgggaccacgcttttctacagttccacaattccacacccaaagagttcaaagagtcactgcataataatccggccaacaggcgcaccacgcccgtctgaactgacctctgacctctgccccacgcccagcacagccttgggggaagtgtacagagatgtctctgaggttgcatggcatggtccttgtgatggtattactttttacaaagaatgaaaccaaatggactcagccctctcccacattttcccctcaccctccaagtcctaacccctccatcctctctaacttttcaagccaatcccttaatgtcattcctctctctgtgtatctgtgccagatgttttcctttcttccttctttactggaaggacctccacattcttccctccttggaagaggactttactaaaagtcacaggtggtggccaggggggatttccgaatctccatcaggcgcgctcatagttgtccccattgtctacccacacaaatcctcaggaaaccaaccaccgcccaggtggccctgagggaggcattcacctttatgtgttagaaaaacatgaccagaaatcaaagatgtcagagccccgaagcagctaatgtaataagcactcatgttattaaaggttttgccttgtcgtaaccaaccgagccgggggtgttttgtttcttgtgggtgtttcctacacaaactcactcccctgcctccaaactggctcatgtccatcttggaagctgaactttgctcatccacacttgagccactaggaaggatctccctgcacctttggaagctagtaaggcattcccacaaatgtccaaatcaatgcatccttctacttgaattcctggaggctacctgggggtgggtgagtgaatgctggttttcaagatctaactttggcatgcaatagctctagaaccttgggcaagtcacctaagcctcaagcctcagtctcctcatctgtaaaatggaacatgataatagcactctcctccacagagttatgaggtttaaataaaactgtgtgtaaaa

SEQ ID NO: 113157 - DNA, 3380 bp, Homo sapiens
  Payload ID: 2133
  Gene Symbol: CACNG4
  Gene Name: calcium channel, voltage-dependent, gamma subunit 4
  Uniprot ID: Q9UBN1
  ENST ID: ENST00000262138
  CDS Start-End: 3-986
ccatggtgcgatgcgaccgcgggctgcagatgctgctgaccacggccggagccttcgccgccttctcgctcatggccatcgccatcggcaccgactactggctgtactccagcgcgcacatctgcaacggcaccaacctgaccatggacgacgggcccccgccccgccgcgcccgcggcgacctcacccactctggtctgtggcgggtgtgctgcatcgaagggatctataaagggcactgcttccggatcaatcacttcccagaggacaatgactacgaccacgacagctcggagtacctcctccgcatcgtgcgagcctccagcgtcttccccatcctcagcaccatcctgctcctgctgggtggcctgtgcatcggtgctggcaggatctacagccgcaagaacaacatcgtcctcagtgccggcatcctcttcgtggctgcaggcctcagtaacatcatcggtatcatcgtctacatttccagcaacacaggtgacccgagtgacaagcgggacgaagacaaaaagaaccattacaactacggctggtctttttactttggagctctgtctttcattgtggctgagaccgtgggcgtcctggctgtaaacatttacattgagaaaaataaagagttgaggtttaagaccaaacgggaattccttaaggcgtcttcctcttctccttatgccaggatgccgagctacaggtaccggcgacggcgctcgaggtccagctcaaggtccaccgaggcctcgccctccagggacgtgtcgcccatgggcctgaagatcacaggggccatccccatgggggagctgtccatgtacacgctgtccagggagcccctcaaggtgaccaccgcagccagctacagccccgaccaggaggccagcttcctgcaggtgcatgactttttccagcaggacctgaaggaaggtttccacgtcagcatgctgaaccgacggacgacccctgtgtgagccgcctgccctttctctccgctccagcctctccccagaacggctctttttgtcacacaggatggcatgtgatcctcaagacgacgaacaatgaactaaagccaaatgcagccctccctggcctccagaggtggcgtgggctggctttgcacgaaggttgtgctgggagaccggacccggggctgcagaagaagctgaaggctgactttgtcccctccccgaaaaagggtgttttgatgcctcagggtctctgaaatctcccgggaagccccagagctttcctgaggctgcctggccttgatcaacttgggaagacaaaattgagccattatctcctcttggaaacgaatcttgccagaaaaacgggatttcagggccttccctccctgcctgggtgtcgggccaccagaaggctctgccggacgccaagaagacggtctctgggctcttgtcagctgcttttgaacctgaggttcctgcgtcgttgagccagaaatcagaccaccgaagctcactcccttcctctccatctctccctctctccaagactctggcagtggcctatgatcctgaagacagctctgcagccaactggtgctttggcctttgcgctgtcccggggccagcttccctcgacctggggaggccgtggcctgtggaggaggcccaggtaaaggctgggggctgttgctggctatcctctttgcttctggaagtttctgcctcactcagaatgggcaggacagacccactgactggacttcagagtctggagggttccatcggtcaggggaatggcggccacgtgacctcttgccgtgccccttgtcatagacccaaggagcaactctgtcccctgagcgttgggggtcccgggggagaggtggacagacacctccctccaactggcatttggcaacaggagcctggacttctgtgcaagaaagggagacctaagggtgaacagtggccaataaaaaccctagagaacaaacatccatttcctaggtggttacaaatcataacttcctgcaaatcaacgccaggagagcaacttaccttcatttctttgtcttaaaaagtagcagcaactggccccacaactcctgtcattgtaagttattctgccaccacctaacaggacggagtggagtgagtttggataaacggaccgagctgggcttctcttcctccctacagaggggagatctcagcactttgtccggagctgaggaagtggtttctgtgttttacagtttttccagccattcttttcttccccctcctgaagcaagcaaagagcgtggaggcgtgtgcaggcttggaagaagaactctccagaacatggaacttaaccctcttttgtataaaacatgtgctttctaaagaaaaattgtttcttattttttgagactccttgatccaccctggaacagtcgcctgtagtcctggtagctgttgtgcttggaaataacgagcgcatccttgcctcagctacctgctcacagcccatgggtggactcggccccctggggttcagacccaggtccgttcggcctagtgatgatgtcatcgtccatcccatcttcctttgcccccaggaaaggacgcatccaccggtagcggccccagctgactgtcgccgtgtgctggggatctgaaatgaggcctgccagggcccctgtgtgctgtgctccagagccttcgctcccatcagggttggcatcatctgatggcatgtccaagtgtgcccagcagcggatgctgaagcaccagagctcaaggccttcacctgctctaggccagccctgtcaccacctccactgccatgaccaggccgaaggcagggaacgccctccccagtcccgctgtccagcaaggccccgagacttttcttctgtgatttccaaaagcaaggcagccgtgctgttctagttcctctccatccgccacctcccctcccgctgccccagaagtttctatcattccatggagaaagctgtgttccaatgaatcctacctcttgcccagtcccaggcagagtaagcagggcccacctagggaccaagaaagagtaggaagaaggggacgagccgggagcaaaaccacctcagacacccgggccttctcagccttctccccgcggccagctgggtctccggggaccctgggccctgggccgcccattcctggccctcccgctgcatctcagacctgacacccaacggggggatgtggtggcctgtgcccaccttctctccctcctcccgacccgccccctcgcccccacccctgtgtgtttcgccagttaagcacctgtgactccagtacctactactggttttgggttggttgttctgtcttttttttaattaaataaaaacatttttaaaa

SEQ ID NO: 113158 - DNA, 926 bp, Homo sapiens
  Payload ID: 2134
  Gene Symbol: CACNG5
  Gene Name: calcium channel, voltage-dependent, gamma subunit 5
  Uniprot ID: Q9UF02
  ENST ID: ENST00000307139
  CDS Start-End: 61-888
agagcgcagtccgtgctggtgggagcgtggcgactagttgcacagcaacggtccaggaagatgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggagagtgccggggtgatgtctgtgtacctgtttatgaagcggtacaccgcggaggacatgtacaggccccaccctggcttctaccgccctcggctgagcaactgctccgattactcaggccagttcctacacccagacgcctgggtcaggggccgcagcccctccgacatctccagcgaggcctccctgcagatgaacagcaactaccccgccttgctcaagtgccccgactatgatcagatgtcctcttcaccctgctgagcctcggccgcccccatccctggactgtgggtggccag

SEQ ID NO: 113159 - DNA, 1311 bp, Homo sapiens
  Payload ID: 2134
  Gene Symbol: CACNG5
  Gene Name: calcium channel, voltage-dependent, gamma subunit 5
  Uniprot ID: Q9UF02
  ENST ID: ENST00000533854
  CDS Start-End: 238-1065
attggcgccgagcggttccggctgactggacggggcgggcgtcccgggcagcctagcgcggtacctcccgccccgcgcgcccagccggcgagggacattggaccagggtcgggggtcgcggccgctccagcgagagccgtgggtactgccacctgctcacccactctccctagccccagagcgcagtccgtgctggtgggagcgtggcgactagttgcacagcaacggtccaggaagatgagtgcctgcgggaggaaggccctgaccctgctgagcagtgtctttgctgtctgtggcttgggcctcctgggtatcgcggtcagcaccgactactggctgtacctggaggagggtgtgattgtgccccagaaccagagcaccgagatcaagatgtccctgcactcaggcctctggcgggtctgcttccttgcaggtgaggagcgggggcgttgcttcaccatagaatatgtgatgcccatgaacacccagctgacatccgagtccacggtcaatgttctaaagatgatccgctcagccacaccattccctctggtcagcctcttcttcatgttcattgggtttatcctgaacaacatcggacacatccgtccccaccggacgatactggcctttgtctctggcatcttctttatcctctcaggcctctctctcgtggtgggcctggtgctctacatctccagcatcaacgatgagatgctcaacaggaccaaggatgcagagacctacttcaactacaagtatgggtggtcgtttgccttcgccgccatctccttccttttaacggagagtgccggggtgatgtctgtgtacctgtttatgaagcggtacaccgcggaggacatgtacaggccccaccctggcttctaccgccctcggctgagcaactgctccgattactcaggccagttcctacacccagacgcctgggtcaggggccgcagcccctccgacatctccagcgaggcctccctgcagatgaacagcaactaccccgccttgctcaagtgccccgactatgatcagatgtcctcttcaccctgctgagcctcggccgcccccatccctggactgtgggtggccagacaacccttcctgttctctccaggtgacccctgagccccaggcctgtggttgacaggcccaggccacccatgcttagctgttgtcacttgaccccagtcctctccctgcttctccagaagggctctaactgccccagcatgggtgtgggagtctggagtctgtgggcaagctgattgtctgggaacatgggagaagccccgcccatgt

SEQ ID NO: 113160 - DNA, 1853 bp, Homo sapiens
  Payload ID: 2135
  Gene Symbol: CACNG6
  Gene Name: calcium channel, voltage-dependent, gamma subunit 6
  Uniprot ID: Q9BXT2
  ENST ID: ENST00000252729
  CDS Start-End: 591-1373
ccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaagaggtgaatctggcagctgcggtgatagcagtgctgggcctggcagtcatggccttggggtgcctctgtatcatcatggtgctcagtaaaggtgcagagttcctgctccgagttggagccgtctgctttggcctctcaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaatttaacaa

SEQ ID NO: 113161 - DNA, 645 bp, Homo sapiens
  Payload ID: 2135
  Gene Symbol: CACNG6
  Gene Name: calcium channel, voltage-dependent, gamma subunit 6
  ENST ID: ENST00000346968
  CDS Start-End: 1-645
atgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggagaagcaaactgcacctattttaaattcttcaccacgggggagaatgcacgcatctttcagagaaccacaaagaaaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctag

SEQ ID NO: 113162 - DNA, 1635 bp, Homo sapiens
  Payload ID: 2135
  Gene Symbol: CACNG6
  Gene Name: calcium channel, voltage-dependent, gamma subunit 6
  ENST ID: ENST00000352529
  CDS Start-End: 591-1160
ccaagtcctctgttctcaaactctgagcccaagggaaccccggccacatctcctccaaacacacacaggacctcaggtcccttcctgggtaccccaaactcttagccctagtggggtgctcagatctctcaggaaaaccagtttcccttttgttaaccccccagcggggaccccaaagcagccccttggagctgcagggagcttcagcgggcaccagttctcattcctctggagctcttggggggactccctcctgggaagccgaattctatctctaaacctcagggtgggggccttgtttttcctctgggccccgtcttctttgccaagttcttgagggcaacctagaccctcctctgaaccccagaggcttccccagccctggggatcatttttctcttctgaaccccagaagcaatctcgactttcgcatttgagattccagacaggactcggctctccctctttcatacccaggggaaactgagtccctcacccccttcaagaccccaggccgctcctcgctcccgcccctcgaggcccttcgccggctctgcctcctcccccttcccgaccccaccggccataagatgatgtggtccaacttcttcctgcaagaggagaaccggcggcggggggccgcgggccggcggcgggcgcacgggcagggcaggtcggggctgacgcccgagcgcgaggggaaggtgaagctggcgctgctgctggccgccgtgggcgccacgctggcggtgctgtccgtgggcaccgagttctgggtggagctcaacacctacaaggccaacggcagcgccgtgtgcgaagcggcccacctggggctgtggaaggcgtgcaccaagcggctgtggcaggcggacgtgcccgtggacagggacacctgcggccccgcggagctgcccggaggcctgctgctcttggtgagcctggaggtgttccggcattccgtgagggccctgctgcagagagtcagcccggagcctcccccggccccacgcctcacctacgagtactcctggtccctgggctgcggcgtgggggccggcctgatcctgctgttgggggccggctgctttctgctgctcacactgccttcctggccctgggggtccctctgtcccaagcgggggcaccgggccacctagagccacgcgtgagacttctctaagcaaccaccgagccctttgaccttctccattgtacccccaagatctttttgccccatctcctagagaaactgtgttctccctgctcgggggcccatgtttttttacacgcctgcctcctgtccccttatcctttctccctctgtaaatacgtttttctctgtggctgtatgtgggttgcttgggggtgggatgggaagaggctctttgcaaacgagggtccccagagaagactggcggggacctgatggggtagctggggtgtggggttgggggatgaggtcagggggtcttgggtgggagttgggggccccttcatttcccaggtctggatcgattcacttgccgggagagactttttacaactcatctgcagctccgggtgcggttgggggagatagcgaagggtctggcctcgctgtgatctgatttgggattaaaggtttggaaattt

SEQ ID NO: 113163 - DNA, 1016 bp, Homo sapiens
  Payload ID: 2136
  Gene Symbol: CACNG7
  Gene Name: calcium channel, voltage-dependent, gamma subunit 7
  Uniprot ID: P62955
  ENST ID: ENST00000222212
  CDS Start-End: 96-923
tgctgcatggggtcaagcactctggtcggtcccatggagctctgcactgtagcttcccttccacaggccccgcagggcgccccctgcctctgaggatgagtcactgcagcagccgcgccctgaccctgctgagcagcgtgtttggtgcgtgtggcctgctcctggtaggcatcgcggtcagcactgactactggctgtacatggaagaaggcacagtgctaccgcagaaccagaccaccgaggtcaagatggccctgcacgccggcctctggcgagtctgcttctttgcaggtcgggagaaaggtcgctgtgtggcctcagaatattttcttgaaccggagatcaatttggtgacggaaaacacggagaatattctgaagacagtgcgcacggccacccccttccccatggtcagcctcttcctcgtgttcacggccttcgtcatcagcaacatcggccacatccgcccgcagaggaccattctggcttttgtctctggcatcttcttcatactatcgggcctctccttggtggtgggcttggttctttacatctccagcatcaacgacgaggtcatgaacaggcccagcagctctgagcagtattttcattatcgctacgggtggtcttttgccttcgccgcttcctccttcctactcaaagagggggccggcgtgatgtccgtgtacctgttcaccaagcgctacgcggaggaggagatgtaccgtccacacccggccttctaccgcccgcgtctcagcgactgctccgactactcgggccagttcctgcagcccgaggcgtggcgccgcggccggagcccctccgacatctccagcgacgtgtccatccaaatgacgcagaactaccctcccgccatcaagtacccggaccacctgcacatctccacctcgccctgctgaggcccgcccctcggagctccccctgcctcctcctcctcctcgtcttaggggggtctccctgcaatgcagcgcccccttccgtcctcgggactc

SEQ ID NO: 113164 - DNA, 631 bp, Homo sapiens
  Payload ID: 2136
  Gene Symbol: CACNG7
  Gene Name: calcium channel, voltage-dependent, gamma subunit 7
  ENST ID: ENST00000391766
  CDS Start-End: 16-612
cccctgcctctgaggatgagtcactgcagcagccgcgccctgaccctgctgagcagcgtgtttggtgcgtgtggcctgctcctggtaggcatcgcggtcagcactgactactggctgtacatggaagaaggcacagtgctaccgcagaaccagaccaccgaggtcaagatggccctgcacgccggcctctggcgagtctgcttctttgcaggtcgggagaaaggtcgctgtgtggcctcagaatattttcttgaaccggagatcaatttggtgacggaaaacacggagaatattctgaagacagtgcgcacggccacccccttccccatggtcagcctcttcctcgtgttcacggccttcgtcatcagcaacatcggccacatccgcccgcagaggaccattctggcttttgtctctggcatcttcttcatactatcgggcctctccttggtggtgggcttggttctttacatctccagcatcaacgacgaggtcatgaacaggcccagcagctctgagcagtattttcattatcgctacgggtggtcttttgccttcgccgcttcctccttcctactcaaagaggtgacgtccgtgggacctagactctagagttctgaatggagagagg

SEQ ID NO: 113165 - DNA, 2688 bp, Homo sapiens
  Payload ID: 2136
  Gene Symbol: CACNG7
  Gene Name: calcium channel, voltage-dependent, gamma subunit 7
  Uniprot ID: P62955
  ENST ID: ENST00000391767
  CDS Start-End: 213-1040
gcggccgcggggggtggggggtgggaggccgggagggggccgggacgccgggctccggggcgggggcggggggcgcgggcaccggcgaccccggtggcggcggcggcggccgggggaagcctcggggccggtcatgcggctgcggggcccgcggcccggagcgtccgcccagccctgagcgaggccccgcagggcgccccctgcctctgaggatgagtcactgcagcagccgcgccctgaccctgctgagcagcgtgtttggtgcgtgtggcctgctcctggtaggcatcgcggtcagcactgactactggctgtacatggaagaaggcacagtgctaccgcagaaccagaccaccgaggtcaagatggccctgcacgccggcctctggcgagtctgcttctttgcaggtcgggagaaaggtcgctgtgtggcctcagaatattttcttgaaccggagatcaatttggtgacggaaaacacggagaatattctgaagacagtgcgcacggccacccccttccccatggtcagcctcttcctcgtgttcacggccttcgtcatcagcaacatcggccacatccgcccgcagaggaccattctggcttttgtctctggcatcttcttcatactatcgggcctctccttggtggtgggcttggttctttacatctccagcatcaacgacgaggtcatgaacaggcccagcagctctgagcagtattttcattatcgctacgggtggtcttttgccttcgccgcttcctccttcctactcaaagagggggccggcgtgatgtccgtgtacctgttcaccaagcgctacgcggaggaggagatgtaccgtccacacccggccttctaccgcccgcgtctcagcgactgctccgactactcgggccagttcctgcagcccgaggcgtggcgccgcggccggagcccctccgacatctccagcgacgtgtccatccaaatgacgcagaactaccctcccgccatcaagtacccggaccacctgcacatctccacctcgccctgctgaggcccgcccctcggagctccccctgcctcctcctcctcctcgtcttaggggggtctccctgcaatgcagcgcccccttccgtcctcgggactcctcgctcccacccggaggaggctgcgccagctttaggccccgccctcctcccaatggctccgcccacagactcccttatttcaatggccgcgccctcttttcccgacctctccttttcattggtccctctcactcccaaatgactcctccccttcgttggcccgcccctttcctctggcccctcctctccaagaaaattagctcctccctcgttctccacctgctctgagctgggagcagccagaggcggtgcaagcgcccagctccccagagctccccaacctcggacctcaccgcaggggcgctgggctggagagcaggttcgggcagccgtcgggaataccgaccatcctcttctcccttctaacctgggcttcctttttccctgcctaatctcacctcctgacctgctgggtcctccggtgcagtgggagggccggcttgctccacccgcagccccggggtggcgtagggaagggggctggaagccacgggtacggttaacctggcccttccctccccatctcccctacttccctggaaggtcccattctttctcaccggctgggctcttttctgcttcctgaaggttacctgccttttagggggctcttgtctaaaggatcttcttgctttctcagctatccttggcttctttttcgtcttcctcctcctttaactctttctctcctttcctcccttcacccgttcgtcccaagcccttgggtgcatcccgccctaggcgcacaccagacggccagaatggggaccctagggtggagggaattcccccacgccatctccgcacctgtgcccgcctctcccccctcgaggccccgtcgagggagggaggggcagtagcgggggtcgacaccccccccaaacctctaagtcttccattttctggctctcctcctcattgacgtccctcttcccccctcagaaccccaactctggcctctttcaagggcccgtccgccccgttggacagattttggggggagaggaggtcaccaggaactcgcccacccccccttattagggaaagaggggcgaggtagcacagtgctgtacacggaaccagaatggcccccggggtggggggaggggggcaggggagggacgggggcttttagtttgcatcttaggtgggaggggggaggggggacccgccgcagttaacctgactttacgcagcgatttttaacgaggctggggggaggggggcactggggtggggacagggtggggtggggggcctggctctgttatttaccgtgtatcatatgtaaatatcgacagaaacttcaataaactttatttcaaacacgtctccgcctgcccggagggaagggattggatagagggggcttagtctgggtctctgcttctagggttgcaggcctaaagtactgcagaatgacgttagatgggtcgttgttaaatgacttaatcatcatcattatcaacggcagcgctttatacttcagtccgtgtaaagcatgcaggaccgtaaatgatactggtcaggatcaataaacgctttctcctggta

SEQ ID NO: 113166 - DNA, 8747 bp, Homo sapiens
  Payload ID: 2137
  Gene Symbol: CACNG8
  Gene Name: calcium channel, voltage-dependent, gamma subunit 8
  Uniprot ID: Q8WXS5
  ENST ID: ENST00000270458
  CDS Start-End: 104-1381
ccccgcttctgcctgcgctgtgaacccccccccagccgccggcacggccccgcccccgctgccccggtggtggcccacggccccccggctgcccgtggtcaaactggagtcgctgaagcgctggaacgaagagcggggcctctggtgcgagaagggggtgcaggtgctgctgacgacggtgggcgccttcgccgccttcggcctcatgaccatcgccatcagcactgactactggctctacacgcgcgccctcatctgcaacaccaccaacctcacggccggcggcgacgacgggaccccccaccgcgggggcggcggcgcctcggagaagaaggaccccggcggcctcacgcactcgggcctctggaggatctgctgcctggaagggttgaaaagaggcgtctgcgtgaagatcaatcatttcccggaggacacggactacgaccacgacagcgcggagtatctactccgagttgtccgggcctccagcatcttccccatccttagcgccatcctgctgctgctcgggggtgtgtgcgtggcggcctcccgcgtctacaagtccaagaggaacatcattctgggcgcagggatcctgttcgtggcagcaggcctgagcaacatcatcggcgtgatcgtgtacatctccgccaacgcgggcgagccgggcccgaagcgggacgaggagaagaaaaaccactactcgtacggctggtccttctacttcggcgggctgtcgttcatcctggccgaggtgataggcgtgctggccgtcaacatctacatcgagcgcagccgcgaggcgcactgccagtctcgctcggacctgctcaaggccggcgggggcgcgggcggcagtggcgggagcggcccctcggccatcctccgtctgcccagttaccgcttccgctaccgccgccgctcccgctctagctcccgctccagcgagccgtcgccgtcgcgggacgcgtctcccggcggccccgggggcccgggctttgcctccacggacatctccatgtacacgctcagccgcgacccctccaagggcagcgtggccgcggggctggcgggggccggcggcggcggcggcggcgccgtgggggcgttcggcggcgcggccgggggcgccgggggcggcggcggaggcggcggcggggcgggtgccgagcgggaccgcgggggggcgtccggcttcctcacgctgcacaacgccttccccaaggaggcgggcggcggcgtcacggtcacggtcaccgggccgcccgccccgcccgcgcccgcgccacccgcgccctctgcgcccgcccccgggaccctggccaaggaggccgccgcctccaacaccaacacgctcaacaggaaaaccacgcctgtgtaggggcgcggcgggggagccgaggggcgtgtccggggcgcgtgcgcgggcgcgcgtgcatcgaggctgccggggtcgggggcgcccccgctttcccccgtgagcgcgctggagactgctgggcccgccccacgcccaccctccccgcccccctccccctccgaagcagggaccccgagggagggggcaggggagggagggggccgctgtgagggagcgtcgtgttttatttttttgggggatctatggggaggggggagggccatggtgttttttgcagtttcgagatgttttctttttcatgttttgctgtgtgcatggggggcggggcggggggaggggagggagggactcccagcccagcccaactcctggagaggggcccataatacacgaatacatagttacacccacaaactatatatatgccctatataaagagacacagcgaagggatgcagaaaggcagaaagaagggttggacgcgggcattcattcatttttttcattcattattccacaagggcttattaagcacctactgtgtaccaggcactggtacataagaaggcattggagcaggggacacgaacgaggcacagaaagggccttctcattcattcattcattaccggcaatttatttgtgcgccttaaaaagctaggcattgtgctccgtgctcagcgtgcaggaggcaggaaaacagccaggggccccgacgtctcatagagtaaacatcttgtgcatgagacaggcattaatcgatcatgtacatacacaataaattacagttaggctataggagaaacgagatgctatgaaatgctccatcaggggagcctaacccagttgtgaggaagagatttcagtggacagtgaaaggatgagaagaagccagcagggcggagctggggcaggagtgtggcaggcagagcagcacgtgcaaaggccccggggcaggaaggagcttgcagcgagggctgaagggtagtgaggcaggtgagcggggatcaaggtgaggccggagacacagacagggccagattgtgcaggggctcgtaggtcaggagttcagattttattctaggagtggtgagggccgtggaacgggtttaagcaggacgctaacgtgaatggtgtacaaagggaagacaggaactcggaggcaagagtaggaggcagagatgtgctgaaatacagcatcaaacatgggcacgggcccttggagctcacactcttgtgggaggaagcacgtaattacacagatgctgaagcatagtcatggtgtctggtgtgcaggagaaagccgtggggcttagagactcatgtgtctgtcactcgttcattcagccactcacccattgccatttttggccatctgctaaggtaccaggaagtgtgttaggatccagatccccaggggtgaaacagactctagccctgctctcaagcagtttattgtcatcaaacaccgccatccaggcagggcaatcggtgctggaacccggaccaccgtgggtaccgtggcacacggtggacagagtgaccaactgccaggagtgagcagcacttggggtaggcttcctggagaatatgatgcccattctgggtcttgaagaaatgagtgggcatcttctggttgatgaaaggcatgagaaaggcttgtggggccaaagaacaacttgggtgaaaacgggaggaagtgaacgagcatgatgtattggggtcagtgctaacagttctgggatgctgatgtacaaggtggggctgggagatgaggccgggaaagtagccacaagctagagtgtaaaggtaccagggtggccgggcgcggtggctcatgcctgtaatcccagcgctttgggaggctgaggctggagtatcacttgagcccaggagtttgagaccagcctggataacatggcgaaaccctgtctctacaaaacattaaaaaaaattagccgggcgtggtggagcacacctgtggacacagctactcaggaggctgagggaggaggaccatttgactccaagagttcgaggctgcagtgagctaggatcgcggcactacactccagcctgagcaacagactgagatcctgtctcagaaaaaaagagaaaaaggtgcctgagttccaggcagagggactgaggctcttctaaggatggtgagagaggatgacagctgcgcgggggcaagggctgtgcggtgattggaggggatgggtttgaagttcactgagaaggcagaggggacagcgcccagtaggcttcccttccatatttgctcagcaagtgtttcctgaggcctcccccgaagccttgtgctgggcggtgctgggagtggagaggtgattttgatcttgccctgctctcaaggggctcccagtctggcgggaaaacaggcacagacgcagcttgaggaggacgtggcagcggtggtgccatgctgccaggggctctgcgtgcccttctcttgacggaagggtacagatcagagctgggtgttcagaatttctctccgaggcctgtgtggaaggaccaggaagagagagactgaaggtccctaggaagaattctgccaaggcggtttcaggaagagatgctgggaaatgtaggaaaaggaatacaaatcagtgagacggagaagcgctgagtgagagagacggatacgtggagagaagagggatgccggagcgggtgttaaaagagacaaatctggccgggtgctgtggctcctaatcccagcactttgggagactgaggcaggcagattgagctcaggagttccagaccagccaacatattgaaatcttgtctctaccaaaaatacaaaaattagccgggtgtggtggtgcacgcctgtagtcccggctactcaggaggctgaggtgaaaggatctcgcttgggcctgggagggtgaggctgcagtgacccgtgatggcaccactgcgctccagcctgggcgaaagagcgagactctgtctcaaaaaaaaaaaaaaaattgagagacagcaaatatttgctggaagagggagagggaactggttaggggagaatggattctagagtctgaaggccaaacagaacgagagagagagagagagagagagaaagaatgaggttgagggtaggcaggaggaagagcaagatggggagggagggggagagcaggagagaccaaactagtagagtcacagacagagaaaaagtcaaagacaggaaggtgatacagaggagagagaagaggaagaggagagactgacaggtgcacaaatcagagaagtcccagagatagcagaaacacacacagagacagagatagagagggagaggtaagccggagacagactcagagattcgcacaaaaagcaacgtggagactcagaagcaagcgcagcgtcaaggaatgctccatttctggtgtgttgttttcccagtattcaagaaatatttattgagtgccaacctgttctagacccaatctcggccaggggatgtggtggcaaatagacggacaagggcctgctctcctgaaacacactggagagataaacaataaataatatcatttcagtaaccaaaaagtgctttaaaaattaagctgaaggccgggcgcagtggctcatgcctgtaatcccagcactttgggaggccgaggctggtggatcacttgaggtcaggagttcgagaccagcctggtcaacatggtgaaacttcatctctaccaataaataaataaagtagctgggtgtgctggtgtgcctgtagtcccagctacttgggaggctgagaaagaaggatcacttgaacccaggaggcagaggttgcagtgagctgagatcgcgccactgcactccagcctgggcgacagtgagtggtaacagaatgacagagcaaggatgactttagatgaggtccttggagtagaccttgtggcagaggtcacagagatgtggattgtgagtaggaaagagaggtgagaaagtctgggggccaggcattccacccaccagaggcagccccaaagcccagaaaagtagcaggtcttcgaggaggcctgtgcggtgagcagatccaccataggacagaggcacagggtaggggctgatcagttagggccttggatccttgggaagaaatctgaattttattctagatctgatgggaagtgcttggagggttttgagcacaggcatgccatgatcatatttttattttcttatttatatttattttgaaaaagagtcttgctctgtctcaggctggagtccagtgggctgatctcggctcactgccaacctccgcctcccaagttcaagtgattctcctgcctcagcctcctgagtagctgggattacaggcatgtgccaccacgcctggctaatttttttgtatttttagtaaagacgggatttcaccgtgttggccaggccaatctgaaattcctggcttcaaatgatccacctgcctcggcctcccaaaatgctgggattacaggagtgagccactgcgcccggcctcatatttttatttaaacaagaacagcagaattacattgctgtgctgagcatacgtagacttcaggagtcaaaggggaaggaaggaggtagcgggctgttgccttcctctggttgctggaggcctggaccaaggtggagttagtgggatggaggaagtggaagaaggcatgggattttggaggctagagcctgcattggtggtgaactggatgtcatagaggagggaaggaaaaggaaccaggaagagaagaactctctgaattgggcacgcacatctctgatgggcaccgatgaggattgttaccaggaacgaggagactgggatcaggaaagtggctttgggagggaggaaccaaggcttctcttttggatgtgtcaagatagatctgccttcgagaaatccgagttgtggtatcaaatagccagttggatatgtgagactggagtttgggggaaagagaggccgtggctcaaaaacgtaagttttggaaacgtcaacataaagccacaggattgggtgacgtggcctagcaggggggtggggacagagaagcgaccctggccagagccttggggacatctacatctgggggagaaggggatgtagcaaaacgagcttaggagtgatctcgaggtaggctgaaaccaggagggttacagagggcaaatgcacctttgtgtttcaagaaggagaggagacagccagctgtgccaagggctgctgagacttggacaaggatgcagagagcagagtgaccattaggtctgatgacatggacagggttggtgatcttgataagataagatgtcagttcagtgcagtggtggggacagaagccctgctggagtggaggggagagagaatttggggggaagacagaaggaaagggaattcaggcaagtgtgtgtgtgtgtgtgtgtgtgtgtgtgtgtgtaactgacacaaaggccaggtgcgatggctcacgtgtgtaatcccagcactttgggaggccgaagtgggtggatcacttgaggtcaggagttcgagaccagcctggccaatatggtgaaaccccgtctctactaaaaatacagaaattagacaggtgcggtggtgcacacctgtaatcccagctacttgagaggctgaagcaggagaatctcttgggcccaggaggcagaggttgcagtgagccaagatcacaccactgcactctagcctgggtgacagagcaagactctgtctcaaaaaagaaaaaaggtaaaaaaaaaaaaaaatgaccctgaaaggaagtagggagacatgcagatagggagatgggaggcagaaaattgcatcctgcaattagctgtcacagcaggcaggagcaagagagatggggaagcccagggccaggaggggaagatgaattcagggggcagggaagagaggatgctgtcagctaggctctggcagatcccctagccagggatgctctgcccagctcctgtctcttgctgctgtcagcgccgggcacactctgggattccccctgtagaccctgtcaagacctattgaggtgaaggggaagaacacgttttcatcattcattttcagaaataaacattcactcagttcttggaaatactttctggccaggcttgggggctcatgcctgtaatcccagcactctgggaggccaagacaggaggattgcttgaggcttggcgtttgagaccagcctgggcaatatagtaagaccccgtctctacaaaaatgaaaaatgagctgtggcgtggtggctcacgcctgtagtcctagatactcgggaggctgaggcgggaggattgcttgagtccaggagtttaaggttgcagtgagctatgattgcaccattgcacttcaggctgggccacagagcaagaccctgtctcagaaaacagaaagaaagaaagtcaaagaaataaagtcaaagacaagaaggtgatacagagaagacagaaaaggaggaggagagagactgacaggtacacaaatcagagaagtcccagagataacaaaaacacaaccacagagatagggagacgtaagccggagaaagacccagagattcgcatagaaagcaacgtggagactcagaagcaagcacagcatcaaggaatgatcaataaaaagaaaaaaaaatatttcctgaggacttccaagtacaaggccctgcaatctcaggccacttctgtcccatctctgccttcagagggggggacaggtagtccagacaattagaatacagagggggctgtgttctgacggggccacgcgggcattgaggaaacgcagcaggcccctcccctagctggggcggggatgtctgtgtgccatcatctcactccatctggtcattcctttgcccattcatccatccattcattcaagtcaccccatgcacattttccaagactgcctgtgacctggccctgtgccgggtagagctgaggatgccaaggtgaattcctcctgtgcctggccccggccccagtctgctggaagaaccagacacagacaatcacactgcggggaaacacgtgctccatcggaaaagtccagagcagggggtgggcagagaggcccagcgtgcaccagagcctcgctcaggtcagcgccaggcctgcctggagcagccaactgtgggagaagaaggagttggtgaaaggtgggtcccacctgggccgtccacagaagggctgaggggtagggggtgaggggttgaagatcaggccctgccgccatgccacacggctgtcctctgtccctgctcctgggggagctgaaactgcatggaaggtcccccaggggtgccccgtctaataaactcgatgaagagga

SEQ ID NO: 113167 - DNA, 6655 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000347598
  CDS Start-End: 1-6561
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113168 - DNA, 6616 bp, Homo sapiens
  Payload ID: 2138
  Gene Symbol: CACNA1C
  Gene Name: calcium channel, voltage-dependent, L type, alpha 1C subunit
  ENST ID: ENST00000327702
  CDS Start-End: 1-6522
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggagagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113169 - DNA, 6968 bp, Homo sapiens
  Payload ID: 2138
  Gene Symbol: CACNA1C
  Gene Name: calcium channel, voltage-dependent, L type, alpha 1C subunit
  ENST ID: ENST00000335762
  CDS Start-End: 266-6757
ggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacagaggcactccggcgggcatgcttgatcagaagaaagggaagtttgcttggtttagtcactccacagaaacccatgtgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcg

SEQ ID NO: 113170 - DNA, 6634 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000344100
  CDS Start-End: 1-6540
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatggggccctcctgttctcacccccctcttgctgtgctaactgcacctcctgttgccgacgggttccagaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113171 - DNA, 6535 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399591
  CDS Start-End: 1-6441
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113172 - DNA, 6535 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399595
  CDS Start-End: 1-6441
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113173 - DNA, 6511 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399597
  CDS Start-End: 1-6417
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113174 - DNA, 6511 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399601
  CDS Start-End: 1-6417
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113175 - DNA, 7377 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399603
  CDS Start-End: 1-6417
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 113176 - DNA, 6571 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399606
  CDS Start-End: 1-6477
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113177 - DNA, 7482 bp, Homo sapiens
  Payload ID: 2138
  Gene Symbol: CACNA1C
  Gene Name: calcium channel, voltage-dependent, L type, alpha 1C subunit
  ENST ID: ENST00000399617
  CDS Start-End: 1-6522
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggagagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 113178 - DNA, 6568 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399621
  CDS Start-End: 1-6474
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113179 - DNA, 6562 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399629
  CDS Start-End: 1-6468
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113180 - DNA, 7590 bp, Homo sapiens
  Payload ID: 2138
  Gene Symbol: CACNA1C
  Gene Name: calcium channel, voltage-dependent, L type, alpha 1C subunit
  ENST ID: ENST00000399634
  CDS Start-End: 1-6630
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 113181 - DNA, 6568 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399637
  CDS Start-End: 1-6474
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113182 - DNA, 6595 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399638
  CDS Start-End: 1-6501
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113183 - DNA, 6511 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399641
  CDS Start-End: 1-6417
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113184 - DNA, 6511 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399644
  CDS Start-End: 1-6417
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113185 - DNA, 6529 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399649
  CDS Start-End: 1-6435
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgagaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113186 - DNA, 13433 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000399655
  CDS Start-End: 266-6682
ggaaggggcccggatgtactgaggatgcgttacagtttcactcgaggaggcagtagtggaaaggagcagtttttggggtttgatgccataatgggaatcaggtaatcgtcggcggggaagaagaaacgctgcagaccacggcttcctcgaatcttgcgcgaaagccgccggcctcggaggagggattaatccagacccgccggggggtgttttcacatttcttcctcttcgtggctgctcctcctattaaaaccatttttggtccatggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtcta

SEQ ID NO: 113187 - DNA, 6568 bp, Homo sapiens
  Payload ID: 2138
  Gene Symbol: CACNA1C
  Gene Name: calcium channel, voltage-dependent, L type, alpha 1C subunit
  Uniprot ID: Q13936
  ENST ID: ENST00000402845
  CDS Start-End: 1-6474
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagagggacccagcccatcagaggcccaccaaggggctgaggatcctttccgccctgcagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagtt

SEQ ID NO: 113188 - DNA, 7590 bp, Homo sapiens
  Payload ID: 2138
  Gene Symbol: CACNA1C
  Gene Name: calcium channel, voltage-dependent, L type, alpha 1C subunit
  ENST ID: ENST00000406454
  CDS Start-End: 1-6630
atggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaa

SEQ ID NO: 113189 - DNA, 6811 bp, Homo sapiens
  Payload ID: 2138
  Gene Symbol: CACNA1C
  Gene Name: calcium channel, voltage-dependent, L type, alpha 1C subunit
  ENST ID: ENST00000480911
  CDS Start-End: 26-3865
ctcctattaaaaccatttttggtccatggtcaatgagaatacgaggatgtacattccagaggaaaaccaccaaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaatgcgaccatctccacagtcagctccacgcagcggaagcggcagcaatatgggaaacccaagaagcagggcagcaccacggccacacgcccgccccgagccctgctctgcctgaccctgaagaaccccatccggagggcctgcatcagcattgtcgaatggaaaccatttgaaataattattttactgactatttttgccaattgtgtggccttagcgatctatattccctttccagaagatgattccaacgccaccaattccaacctggaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaaggtaggcctctgagaaagacctttgattcccaggcatcaggggtggacagaacggggaggtggggtgcaggtattgaaggcagaatgaggggaagagggaaaaaggcatcggtgaaggaccatccctgctccgatggtcagtgccccaactcctacacctgcccagagctgaaccaggccaactccaggaaacactctcagctctcagtgttgaccctggctggcatgcacaagctgcagattcctcgctgagctgaacctctgagcctctcctaggagaggcaggtgatggtctttctcctatgtcccatcctctagtacataacctgttaatagaagaaactatgctcatagactggcagaccaaacctctccaggcccagccccccagatccactcaggcctctgttccaccctcctcccatttcatcagccacacagaccaacctcatataaaacattcagccagggctggatttgctcagggctcaggactgagggctccagcccatgggcactcctgttccctgcctaagaggctatggcattgctccttacatgctctggggcaggaagaacaattaccagcaaatttctctgctttgttccttgtgtaagggcaagaagattaggcctgctgctgaatgaggcagggtcagaattcctgttctttggatcatctgtgcccttcctagccagtcacccccattgtcctcagtggtggaggagcagacactggtatgagccacaccttccaccctgggcctctgtagatgggtcagaatcacgggtatccactggccgggattcaccaccaggacagctgcttctgagggaggctataagagcaactgagcagcccccaggctaccataacaccttttggagaaggatgagaaggaacgagttctaggagcatcatgcagttacagacttgagacaatctctccagcttactgagccttcccctccctcctttggtagttttcccagaggcaacacagatcaacaggaggccaagagcaagaatccctggccatatcttctattttcattcaagtttttactggtctcaagattaattgggggtgggggagggtccagctcggcctttgaatccatgttcattgaggagatatccacagccttctttgaatgaatattcactcacactttggattccatatcatgtgctacatgtatatcatcgcacgtcattctcaaaacgtccctttaaagtaggtattagcatccctctgtggagaagggggaagggaggctcaaacaattaagtgcccaggattaattgatccactgctaagaactggcagaacggagactggaatccggcacctctgacttcactgtattttccaccacactgaggttaactatcattttcccatgtcaagtgttctgcgggtattttttagcaagagggaaacaaccttggagggacttaaaagataagacaatattcctacaatgcagattcttctgtcactcaaagaatgcctggggatcccagctgattttcatagaggaagtctcctaagggacatcctttggtgatagaacggtggtttcctgccttctccagagaagcaagtacactctttttcaccttcctgtacaagtcccatttaggaggacagatcttgtcctgacctagagaggacccctgcgttgccctgacaccttccttagggtacacggtgtctgtgcccacacatggtcctattccaagccctgcagcccaggagctctgacagttcgccacccacagcagcatgaccagctgaggccaggagtgcagtcactgcctagccgagcctcagtctcggatgactcctctcagtggggaaactggcatcattttcatacagtgtcacgagacatatggtttaaatatttcaaagccttgagtcattccacagttgactcagatgtgtttctgacgatgtctgaggcagtctggagagcctgcagtggactttctgaatcatgcctcctgagcacgggagacatacagacaaccttccctgggaagtgcatgaaattgacacctgcaggagcctccgtcctccgtctaaaagacactccacctaaatcctgccaatcaaggaacaagccagtttcctaggaagtaaccattgcgagtggtctaaactgtaaagtgcctcctaatttcctctgtccctggttttctattgtgagaagatggggcaagataacagagacttttacccaagaaggaagacagccatcctgggcccatttgcatttcacattccagggtacatctatggtgtaaagagaaaggaaaatggatctttccctgtgaatttccctaaaggggctctggcaagagggggataaaggtcaccacccagttaggagcatcatggagcacagctgagtccctggattcttactgagctatgttcttcattcacaaatagactccaggtaaagcagctccaaaattttcaggcagaaaaccaaactggaaaaacttgaagctctggaagaatatccagctggatctggcccaagaaccagtggcttctaaccatgacctgaatccatgacaactttcatttcccaccattaagtaggactctgtgctgcactttttatttcactggcatggttgtttgtgtatgacccagatgagcatcagcatttgctgtgaaaggatggctaggaaccaaggatgttgaagacagtctgaagttgtcactgcttatgtttcgtctctgcaactggctggttggttggtccatcagccggtcaacttgtattcttgcttcattctttcattgttttcatggtcatggatgttcccaatttcttcatttctgtgtgttctcctcaccactccatggaaaataaatttactcaagtaagtccctgccttaaatctaaccatcccactccttaaattcatactctgttc

SEQ ID NO: 113190 - DNA, 577 bp, Homo sapiens
  Payload ID: 2138
  Gene Symbol: CACNA1C
  Gene Name: calcium channel, voltage-dependent, L type, alpha 1C subunit
  ENST ID: ENST00000543114
  CDS Start-End: 278-577
acataggcagggagcagagcagggaagacgaaaatacaaggttgaaaagaatcaagtaagaaggtgttttgttttgttttttagaattctaaaacttaaaaggaattttactgtaacttaaacttgcagcgatacgatacggccatgtcaacttttgtggcactgaaatgttactgcaggaatagcttctgggttttaaaaaattataagagatcatgagcaggataattatttagctttaaaaatcaaccaattaatatacatctggaaattcacaatgcttcgagcctttgttcagcctggtacgcctgcataccagccgcttcccagccacctgtctgccaacacggaggtcaagtttaagggtactttggtgcatgaagctcaactcaactatttctacatctctcctggaggttccaactatgggagcccacgccccgcccatgccaacatgaatgccaatgcggcagcggggctggcccctgagcacatccccaccccgggggctgccctgtcgtggcaggcggccatcgacgcagcccggcaggctaagctgatgggcagcgctggcaat

SEQ ID NO: 113191 - DNA, 831 bp, Homo sapiens
  Payload ID: 2138
  Gene Symbol: CACNA1C
  Gene Name: calcium channel, voltage-dependent, L type, alpha 1C subunit
  ENST ID: ENST00000465278
  CDS Start-End: 1-730
ctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatgtatgcatcgcctgtgtcttctgcactccttccccctggggctgtgccaggcccacagcttctgttgctgacatcattgttcaatcaggagcccaattctaggtgtcataattagatccacaactaacatttcattaagagagtagggctttgatagaaaaccaccctaggaccacaagcaaataaaagagcatgtacccaaa

SEQ ID NO: 113192 - DNA, 12870 bp, Homo sapiens
  Payload ID: 2138
  Gene Symbol: CACNA1C
  Gene Name: calcium channel, voltage-dependent, L type, alpha 1C subunit
  ENST ID: ENST00000620878
  CDS Start-End: 1-6120
gaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggatgcactgctgtgacatgctggatggtgggaccttccctcccgccctgggcccccgcagggctcctccctgtctgcatcagcagctccagggttccctggcggggctgagagaggacacaccctgcatcgtgcctggccacgcttcactgtgctgctcttccagagtaggagagtggctcccagcaggctgcacagccccccagcatgccaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtct

SEQ ID NO: 113193 - DNA, 545 bp, Homo sapiens
  Payload ID: 2138
  Gene Symbol: CACNA1C
  Gene Name: calcium channel, voltage-dependent, L type, alpha 1C subunit
  ENST ID: ENST00000496818
  CDS Start-End: 114-545
gatagctggagaataaccaagtgctgtgcagggctacagaggaaggggaagagataatccctgtccatgaaaaataacaagcttcatggggcacacagcccaggctcaaatgaatggcatatgtatgtaaactgcttatgtctaaaaccaggccattggtgatgatcggagtagcatgggtcatgctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcag

SEQ ID NO: 113194 - DNA, 12834 bp, Homo sapiens
  Payload ID: 2138
  Gene Symbol: CACNA1C
  Gene Name: calcium channel, voltage-dependent, L type, alpha 1C subunit
  ENST ID: ENST00000615400
  CDS Start-End: 1-6084
gaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtct

SEQ ID NO: 113195 - DNA, 12939 bp, Homo sapiens
  Payload ID: 2138
  Gene Symbol: CACNA1C
  Gene Name: calcium channel, voltage-dependent, L type, alpha 1C subunit
  ENST ID: ENST00000615303
  CDS Start-End: 1-6189
gaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggagagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtct

SEQ ID NO: 113196 - DNA, 2833 bp, Homo sapiens
  Payload ID: 2138
  Gene Symbol: CACNA1C
  Gene Name: calcium channel, voltage-dependent, L type, alpha 1C subunit
  ENST ID: ENST00000616390
  CDS Start-End: 276-2765
acagctgggtggggcagaggttatccttgacatctccctccagccccccttctcattgctggagcctcctgttgccctcggagtcccttccagcttcttcccactttcggcaacagcccccacccccaacaaacctaatgctaccaagatgccttgtttcaaaatgaagtgattccagcacagtcattcatgctgggtggtagcaactcagtgagctgcccttctaatagatcattgtaccttgaagagaaggcgatgctcaacctgcaggtggaatgtttattgtatctcagaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtg

SEQ ID NO: 113197 - DNA, 12795 bp, Homo sapiens
  Payload ID: 2138
  Gene Symbol: CACNA1C
  Gene Name: calcium channel, voltage-dependent, L type, alpha 1C subunit
  ENST ID: ENST00000613940
  CDS Start-End: 1-6045
gaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactggatgcaggacgctatgggctatgagttaccctgggtgtattttgtcagtctggtcatctttggatcctttttcgttctaaatctggttctcggtgtgttgagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatattctgttttattttgatattgtttttaccaccattttcaccattgaaattgctctgaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagggttactttagtgatccctggaatgtttttgacttcctcatcgtaattggcagcataattgacgtcattctcagtgagactaatccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggagagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtct

SEQ ID NO: 113198 - DNA, 12795 bp, Homo sapiens
  Payload ID: 2138
  Gene Symbol: CACNA1C
  Gene Name: calcium channel, voltage-dependent, L type, alpha 1C subunit
  ENST ID: ENST00000621625
  CDS Start-End: 1-6045
gaacgagtggaatatctctttctcataatttttacggtggaagcgtttttaaaagtaatcgcctatggactcctctttcaccccaatgcctacctccgcaacggctggaacctactagattttataattgtggttgtggggctttttagtgcaattttagaacaagcaaccaaagcagatggggcaaacgctctcggagggaaaggggccggatttgatgtgaaggcgctgagggccttccgcgtgctgcgccccctgcggctggtgtccggagtcccaagtctccaggtggtcctgaattccatcatcaaggccatggtccccctgctgcacatcgccctgcttgtgctgtttgtcatcatcatctacgccatcatcggcttggagctcttcatggggaagatgcacaagacctgctacaaccaggagggcatagcagatgttccagcagaagatgacccttccccttgtgcgctggaaacgggccacgggcggcagtgccagaacggcacggtgtgcaagcccggctgggatggtcccaagcacggcatcaccaactttgacaactttgccttcgccatgctcacggtgttccagtgcatcaccatggagggctggacggacgtgctgtactgggtcaatgatgccgtaggaagggactggccctggatctattttgttacactaatcatcatagggtcattttttgtacttaacttggttctcggtgtgcttagcggagagttttccaaagagagggagaaggccaaggcccggggagatttccagaagctgcgggagaagcagcagctagaagaggatctcaaaggctacctggattggatcactcaggccgaagacatcgatcctgagaatgaggacgaaggcatggatgaggagaagccccgaaacatgagcatgcccaccagtgagaccgagtccgtcaacaccgaaaacgtggctggaggtgacatcgagggagaaaactgcggggccaggctggcccaccggatctccaagtcaaagttcagccgctactggcgccggtggaatcggttctgcagaaggaagtgccgcgccgcagtcaagtctaatgtcttctactggctggtgattttcctggtgttcctcaacacgctcaccattgcctctgagcactacaaccagcccaactggctcacagaagtccaagacacggcaaacaaggccctgctggccctgttcacggcagagatgctcctgaagatgtacagcctgggcctgcaggcctacttcgtgtccctcttcaaccgctttgactgcttcgtcgtgtgtggcggcatcctggagaccatcctggtggagaccaagatcatgtccccactgggcatctccgtgctcagatgcgtccggctgctgaggattttcaagatcacgaggtactggaactccttgagcaacctggtggcatccttgctgaactctgtgcgctccatcgcctccctgctccttctcctcttcctcttcatcatcatcttctccctcctggggatgcagctctttggaggaaagttcaactttgatgagatgcagacccggaggagcacattcgataacttcccccagtccctcctcactgtgtttcagatcctgaccggggaggactggaattcggtgatgtatgatgggatcatggcttatggcggcccctcttttccagggatgttagtctgtatttacttcatcatcctcttcatctgtggaaactatatcctactgaatgtgttcttggccattgctgtggacaacctggctgatgctgagagcctcacatctgcccaaaaggaggaggaagaggagaaggagagaaagaagctggccaggactgccagcccagagaagaaacaagagttggtggagaagccggcagtgggggaatccaaggaggagaagattgagctgaaatccatcacggctgacggagagtctccacccgccaccaagatcaacatggatgacctccagcccaatgaaaatgaggataagagcccctaccccaacccagaaactacaggagaagaggatgaggaggagccagagatgcctgtcggccctcgcccacgaccactctctgagcttcaccttaaggaaaaggcagtgcccatgccagaagccagcgcgtttttcatcttcagctctaacaacaggtttcgcctccagtgccaccgcattgtcaatgacacgatcttcaccaacctgatcctcttcttcattctgctcagcagcatttccctggctgctgaggacccggtccagcacacctccttcaggaaccatatcctaggcaatgcagactatgtcttcactagtatctttacattagaaattatccttaagatgactgcttatggggctttcttgcacaagggttctttctgccggaactacttcaacatcctggacctgctggtggtcagcgtgtccctcatctcctttggcatccagtccagtgcaatcaatgtcgtgaagatcttgcgagtcctgcgagtactcaggcccctgagggccatcaacagggccaaggggctaaagcatgtggttcagtgtgtgtttgtcgccatccggaccatcgggaacatcgtgattgtcaccaccctgctgcagttcatgtttgcctgcatcggggtccagctcttcaagggaaagctgtacacctgttcagacagttccaagcagacagaggcggaatgcaagggcaactacatcacgtacaaagacggggaggttgaccaccccatcatccaaccccgcagctgggagaacagcaagtttgactttgacaatgttctggcagccatgatggccctcttcaccgtctccaccttcgaagggtggccagagctgctgtaccgctccatcgactcccacacggaagacaagggccccatctacaactaccgtgtggagatctccatcttcttcatcatctacatcatcatcatcgccttcttcatgatgaacatcttcgtgggcttcgtcatcgtcacctttcaggagcagggggagcaggagtacaagaactgtgagctggacaagaaccagcgacagtgcgtggaatacgccctcaaggcccggcccctgcggaggtacatccccaagaaccagcaccagtacaaagtgtggtacgtggtcaactccacctacttcgagtacctgatgttcgtcctcatcctgctcaacaccatctgcctggccatgcagcactacggccagagctgcctgttcaaaatcgccatgaacatcctcaacatgctcttcactggcctcttcaccgtggagatgatcctgaagctcattgccttcaaacccaagcactatttctgtgatgcatggaatacatttgacgccttgattgttgtgggtagcattgttgatatagcaatcaccgaggtaaacccagctgaacatacccaatgctctccctctatgaacgcagaggaaaactcccgcatctccatcaccttcttccgcctgttccgggtcatgcgtctggtgaagctgctgagccgtggggagggcatccggacgctgctgtggaccttcatcaagtccttccaggccctgccctatgtggccctcctgatcgtgatgctgttcttcatctacgcggtgatcgggatgcaggtgtttgggaaaattgccctgaatgataccacagagatcaaccggaacaacaactttcagaccttcccccaggccgtgctgctcctcttcaggtgtgccaccggggaggcctggcaggacatcatgctggcctgcatgccaggcaagaagtgtgccccagagtccgagcccagcaacagcacggagggtgaaacaccctgtggtagcagctttgctgtcttctacttcatcagcttctacatgctctgtgccttcctgatcatcaacctctttgtagctgtcatcatggacaactttgactacctgacaagggactggtccatccttggtccccaccacctggatgagtttaaaagaatctgggcagagtatgaccctgaagccaagggtcgtatcaaacacctggatgtggtgaccctcctccggcggattcagccgccactaggttttgggaagctgtgccctcaccgcgtggcttgcaaacgcctggtctccatgaacatgcctctgaacagcgacgggacagtcatgttcaatgccaccctgtttgccctggtcaggacggccctgaggatcaaaacagaagggaacctagaacaagccaatgaggagctgcgggcgatcatcaagaagatctggaagcggaccagcatgaagctgctggaccaggtggtgccccctgcaggtgatgatgaggtcaccgttggcaagttctacgccacgttcctgatccaggagtacttccggaagttcaagaagcgcaaagagcagggccttgtgggcaagccctcccagaggaacgcgctgtctctgcaggctggcttgcgcacactgcatgacatcgggcctgagatccgacgggccatctctggagatctcaccgctgaggaggagctggacaaggccatgaaggaggctgtgtccgctgcttctgaagatgacatcttcaggagggccggtggcctgttcggcaaccacgtcagctactaccaaagcgacggccggagcgccttcccccagaccttcaccactcagcgcccgctgcacatcaacaaggcgggcagcagccagggcgacactgagtcgccatcccacgagaagctggtggactccaccttcaccccgagcagctactcgtccaccggctccaacgccaacatcaacaacgccaacaacaccgccctgggtcgcctccctcgccccgccggctaccccagcacggtcagcactgtggagggccacgggccccccttgtcccctgccatccgggtgcaggaggtggcgtggaagctcagctccaacagggaaaggcacgttccgatgtgtgaggatctggagctcaggagggattcaggctcagcagggactcaggctcactgccttctgctcaggagagcaaacccctctaggtgccactcccgggagagccaggcagccatggcgggtcaggaggagacgtctcaggatgagacctatgaagtgaagatgaaccatgacacggaggcctgcagtgagcccagcctgctctccacagagatgctctcctaccaggatgacgaaaatcggcaactgacgctcccagaggaggacaagagggacatccggcaatctccgaagaggggtttcctccgctctgcctcactaggtcgaagggcctccttccacctggaatgtctgaagcgacagaaggaccgagggggagacatctctcagaagacagtcctgcccttgcatctggttcatcatcaggcattggcagtggcaggcctgagccccctcctccagagaagccattcccctgcctcattccctaggccttttgccaccccaccagccacacctggcagccgaggctggcccccacagcccgtccccaccctgcggcttgagggggtcgagtccagtgagaaactcaacagcagcttcccatccatccactgcggctcctgggctgagaccacccccggtggcgggggcagcagcgccgcccggagagtccggcccgtctccctcatggtgcccagccaggctggggccccagggaggcagttccacggcagtgccagcagcctggtggaagcggtcttgatttcagaaggactggggcagtttgctcaagatcccaagttcatcgaggtcaccacccaggagctggccgacgcctgcgacatgaccatagaggagatggagagcgcggccgacaacatcctcagcgggggcgccccacagagccccaatggcgccctcttaccctttgtgaactgcagggacgcggggcaggaccgagccgggggcgaagaggacgcgggctgtgtgcgcgcgcggggtcgaccgagtgaggaggagctccaggacagcagggtctacgtcagcagcctgtagtgggcgctgccagatgcgggcttttttttatttgtttcaatgttcctaatgggttcgtttcagaagtgcctcactgttctcgtgacctggagttaaccggaacagcgtcttcattcatttctgttgggaccagacgcggagcctgggtgcgcgagccgccctccgggaggaaggcgcccggctgcgtctgcagaggcggggagaggaggcggcgagggtcccggggcgcgaggaaggcgcctgccctctcccagctcgcaggccccgggcccggccgcgcctccgcggggagagcaccccggcttcccgcgcgccctcaccaaaaggaccctacagcaaacgggtgtctttcgactctgcttgtagaaaccatttgcacatattctgtacgagcctcgctgtctccctagagccagggccctgcggatttggagaagggagcggggcaggacttccaggaggaccccaacccggcccggagagggaggaggaggcctccaggggcgcggagctctggggatgggcgtcgggccggcagtggtgcggctcactccgtccctgcccacctgcgacgggatcccccgaccggcacgggccacgccgagctcccggccagccgccggcccgcaggcagcgcgagggaggagctgcgccgccggctccgcccaaccaggtggtgctgagcttccgctgagcgctcttttgttttgtggtttgacacttttcttgacagcatgttgcagtttcttttcggttttggttttttttaaatgttttattttgctttcccagcgggaggggaggaagaagagtgtttacaaagtcctgtagccccctcacctttctgttttcacttttgccaatgtacatcgggtttggttttcttgtattatttaaacggttgtggtttcctttttccacggaggttcaatagaagccgctgcaggagagttttaccaaccattgtgtatgcccaataatttgttatcatttccttaggtagtaacctatttttgttctggtttggttcggttatctaatggaaaggtaactggcaatgcacttgatgtggtcttgcacatgtgggtgatagagttgggttcctttttatgctgggtgtacaggtgggtttgggagagaggagcatgcgcgagagagtctccgagtgtgtgcgacgcgtgtgtgtgtggtgggttgtctgtgtgcatatgtcctgcccgtgtatatgcacccacaccatgtgcccgtgcacaccagtgactacgcagtcccccctttctggtttagctgtgggaagatctgaatctggggccgtttgaaagcaaaaacaaaccactgtctctgcttctgaaacgggaatcagtaactctttgcattttctgtcccacaagatatgcaaaaacaatgcaataatattcatttaaaaatacaattgtgagttgtgttggcattaaaactgtattttaaaaaaagacagaaatttaagggaaaaacacaagaaggcattttgcttcaatatattccgtgtaatgttttattgcattgataatgtttctgttgaagaaaccgttatacttgaattcaggtcagtttcagtatttttcaaatatttttttaaaactgaattgcaattgtgccaagcgaatataatgaattgaattaagttggttttcggattcacttcttgtatattttgctgcatgtaaagtaaatcattttgtatttggagtgtgacaagctttacctttgaactcaagtgcttttctatatgtggttgggggaaagggaacaagttttctttagtttgcacaatgagcaaaggtatcaccagtgtagtcattattctgctctccacaaacaggtttggacattactgttttgcatatcttgtgtttgcttacatttccctcaatttttccaaaatcgtttgctgggtatgtttgtaccgcctcttgctgtgagagaccaggacctattttattccagtcttcactctgtccactctgctctggtcatctgatttggtacttctccaagaacagcccttcactgtgaggtgcagggaggcgttctgatgagccctcagtcactgggccgtcatccgcatcccccatggaagaggtagctggctttcccttcccttccaccacacggaattttctctttggcttccttaggaaagtgtacactaaccgggaggataaaattaaagtcaggctgcttggagggaggggcatcctcacttccggattcttgttgctctacccaacaaggacagcaggggctcgagaaaggaactggtgaaaccctgatccatctgaaagtcaactctgcgtgctcctttctccatcccttcctcactctggagcagcctttccttcaggcttgccctaatgtttgggctgccggggagggggccaggacaagggaagaggcatccggagctcacagtgggggtgggaacagatttttgtgggggcatctctaatgctcacttatatctccctagaacatcactcttttggtgctgtgtccttcaaatgtatgtcaacagtggtggctgaaaagggactgctttggggaaaacaggacccaaccattcacccagaattgacccattaaatctcttccagtcctagtgttccctgagcccctcttggcacatatataagtaagctagaaattacaataagggacagtccattcctctatgacagcttgctggactgattcatgacaaagtggagaaatgtactcaatactccccggttaacacagtctagaaacagagtttctttatggatatccacacccaagtcatccaaactttcttgattccttttcactgccatcaaggtcctctagaaattgagtttaggtatcatcctttgaaaagttcccaagatttctaccaggaggtacacacaggcgttccctgtctagggcaggaggactatcctagcttgaccttctgatccactagaataagactggcgtatgatgcctgtcatcagaacagactggcacaagtagtgacatcaatgaaccacagcacaatcttccaagtgatgtctactctccacctaaaatggaattttccccatgaccttgtaaaacataattgtcacatcttccatacccctcctgacagcccccaagtgtcaggagaaaacagtcaggggctaagggcccaagggacttgaagaaacaacagtttaaggtctgcagtttggtcaacttaattcttgtcctccgaccagccctgcctctttcatttccagaccttggagaatttttcccagctttgattcagaaggtactagttataacccctttccttcttcttaatccaataggcctcactctcactgggaaatccactcaaaggaacaaggcaatgtctctcattctatttcccagttccaaattccaggtgcttgtctggagtgaagctacccgttactttctcccagcttttctccacccagcatgtctcctgcccatgcagctgaagacagtggggcaacctcaggagaagcagacctttccatgcccaagttcatctcctgagcaacagtgacacctagaaaatgaggactttggaagtcacccaaaagatggtggctactttatggagtcctgaagatacacagccaccactcctaaaggcaaagaaagaaaacacgaatgtaggtcagggatagagtggaaccctggtcatcggggtttttagcctcatcgtgggaaaggtggtaaaggaggatgatggcatctccatccctagaggccaagaattgaaatatcattgtcaaggattagaaacaattcagcaaagaggccacaaaaagggcctgctgactcccagaagacctctttaaaccccaggggaggcaaatacttgctgatggagtctgggccgtttccatattttaaagaagacctgcctctggggcaaatgtcagcacagagaggactgggaggagaatggaggcaagaaaagggcatattttgactccctctgtgcctcttcccagttcatggaaggatgtgttcagcttacccacccacagtgaccagtgtggtggagccgctgacatctcaaggatctatttgggaaggtgagaagagtactcattccatctgggggtgttgttccagccacatcagcctacctggtgggatgtgggggtgtctgccaccctgtcccccctctgctgatgtccctcccctcaggctgtccaggtgccacctgacacaggctgctgtgcaaagacaggcggggaagcccaaacctcactcccagggaggccctcagccgccagagtccaggttctccagaggctacgatttgaggaggttgagggggaagacaggagggaaagaaaagtcctacaactgtcaggaatggggcacctttccctgtccctaagcaaagctccctcttcccactgccctccccagccccagctccctgtcctccccaacacctagtgagaaagacggtgcgtggaagggagtcccatgggcagatgcttacacgacctctttgtgaagcctcttctgggtttaacttcattcatcaatttattcttatgtcaaagcaatgaaacttttctttctggagccagataccaatacaacaggtgaacgggtttctgccacatctctacattgacgggggatgcttgaacaacccccctcactacacagacacacaccgttaaggcacaagggctggggttgagctctagatgagggactttcctgctcctgcaagggtgagcactgtatacacagacaaggagggtgcagtagagtgactcccttggatggaagtagtaccatcagaacctactattattatgacataaattctatttacatacattgagagaatactacaatcaacactttttcctgggatgactttaagaggtttgagccacagcacctgaagtggcaaagatccatggtctttgtagggtattagagaactcttccagtcacctctgaaagcactctagatcttgcagctgagtggatgaagtgtaacaaatctgttgcacgctgagaggagtcagaattagcatttttcatgaaagttccccacgtctctactaagaatgaggaagaaaagactaagactaggtaattacacagaggcttgaaatgttacatcaccagagccaagtcctctcccttcagatcagttactggctgctacacagggacacccccaccttttcagggcatcccatgcactccacttctcaggatctaaggaatttgactttgtagggatcccagaaagggcactgtgccacttcccctggtgtgaatcagacatacattgtacattcatttctaaaattcactcatgcacctcaaaccaaggtcattatccaaaaaaaaaaaaaaaaagctctgggtggaagagtttgtaagttttaagagagggtcatttctatgtgaggaaatgcagaaatggacagaatgattcttattcactgtttgggtctggagaattcccattgtggaaatcttagagatctcaagtttattaccaagggaataaggaaaaaaaggtgagcaggcaccaggccaagcagtggctcccttgccaaggaacctgaggctgcaggtttcagggacccccttgaagaaacctctcctggccattggccaggagaaaagagaagtctctcctgtagagtcacaagagaagcaaaagagggtgggtcactgggtcctggacatagcccccaaccccaagacttcccaatatggagaaactacaccaatgtttaaaaggggaaaaggaaagaacttgtacatcaagggaagatgatttgtaaacacacagtcctgtgcagaaagatccccttcaggaggtgtctccagcatcccaaagctgtgcgcaccttctcttttcctgcctcaggccacctatgcatccagctgcagcccatacccacacctgaaatccatctcttgaatcccagccaggttatataccaccccattgccatgtcctgtcctggccagaatgcatgctgttcccccaagcctcgtgggagtgaggccatgggaaacagagatgagcatgtctggacaagtctgtgatggtagtggatgagaataacccatggcaaaacacgcacattcattaagaaatagggcgacagattccccgttggtgaagcactgaaaggtctattactctcataatattgctgttttattttaatccaccagagctaccatgcaaaactttcctcctgtgaaacgctccagataaagctcctctaatctccccttccctcatgtcctccagctcaaacccaccttcatcccccaaaccaatctgtatcatgcctgttatcagagaggcacagaaagatgggcagtgcctccgttgtcaccattccccacacccctacacacccccacaccctcccctccaggctccacgacttcacagtcttactgttgtaaatatcattgtacagtttgtaatcctcaaataatcccattgtcagaggcctcgcctgatgggccttctcaccctcgagaaaggccagggaatctagaaggggcaacccttcaaggagagcttcagggtcatctctgtgtgagacactattgtatattcctgtaagattgcatttttatctaaggaatgatgttatttaaaaaacaaacaaaaaacacaaaaaataagaattgcaaataaatttcttaacaatgtct

SEQ ID NO: 113199 - DNA, 7636 bp, Homo sapiens
  Payload ID: 2139
  Gene Symbol: CACNA1D
  Gene Name: calcium channel, voltage-dependent, L type, alpha 1D subunit
  Uniprot ID: Q01668
  ENST ID: ENST00000350061
  CDS Start-End: 512-6997
gggcgagcgcctccgtccccggatgtgagctccggctgcccgcggtcccgagccagcggcggcgcgggcggcggcggcgggcaccgggcaccgcggcgggcgggcagacgggcgggcatggggggagcgccgagcggccccggcggccgggccggcatcaccgcggcgtctctccgctagaggaggggacaagccagttctcctttgcagcaaaaaattacatgtatatattattaagataatatatacattggattttatttttttaaaaagtttattttgctccatttttgaaaaagagagagcttgggtggcgagcggttttttttttaaatcaattatccttattttctgttatttgtccccgtccctccccacccccctgctgaagcgagaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcac

SEQ ID NO: 113200 - DNA, 8991 bp, Homo sapiens
  Payload ID: 2139
  Gene Symbol: CACNA1D
  Gene Name: calcium channel, voltage-dependent, L type, alpha 1D subunit
  Uniprot ID: Q01668
  ENST ID: ENST00000288139
  CDS Start-End: 119-6664
agaataagggcagggaccgcggctcctacctcttggtgatccccttccccattccgcccccgcctcaacgcccagcacagtgccctgcacacagtagtcgctcaataaatgttcgtggatgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagtaatattcaattaattagacttttgtataagagatgtcatgcctcaagaaagccataaacctggtaggaacaggtcccaagcggttgagcctggcagagtaccatgcgctcggccccagctgcaggaaacagcaggccccgccctctcacagaggatgggtgaggaggccagacctgccctgccccattgtccagatgggcactgctgtggagtctgcttctcccatgtaccagggcaccaggcccacccaactgaaggcatggcggcggggtgcaggggaaagttaaaggtgatgacgatcatcacacctgtgtcgttacctcagccatcggtctagcatatcagtcactgggcccaacatatccatttttaaaccctttcccccaaatacactgcgtcctggttcctgtttagctgttctgaaatacggtgtgtaagtaagtcagaacccagctaccagtgattattgcgagggcaatgggacctcataaataaggttttctgtgatgtgacgccagtttacataagagaatatcactccgatggtcggtttctgactgtcacgctaagggcaactgtaaactggaataataatgcactcgcaaccaggtaaacttagatacactagtttgtttaaaattatagatttactgtacatgacttgtaatatactataatttgtatttgtaaagagatggtctatattttgtaattactgtattgtatttgaactgcagcaatatccatgggtcctaataattgtagttccccactaaaatctagaaattattagtatttttactcgggctatccagaagtagaagaaatagagccaattctcatttattcagcgaaaatcctctggggttaaaattttaagtttgaaagaacttgacactacagaaatttttctaaaatattttgagtcactataaacctatcatctttccacaagatataccagatgactatttgcagtcttttctttgggcaagagttccatgattttgatactgtacctttggatccaccatgggttgcaactgtctttggttttgtttgtttgacttgaaccaccctctggtaagtaagtaagtgaattacagagcaggtccagctggctgctctgccccttgggtatccatagttacggttttctctgtggcccacccagggtgttttttgcatcgctggtgcagaaatgcataggtggatgagatatagctgctcttgtcctctggggactggtggtgctgcttaagaaataaggggtgctggggacagaggagcaacgtggtgatctataggattggagtgtcggggtctgtacaaatcgtattgttgccttttacaaaactgctgtactgtatgttctctttgagggcttttatatgcaattgaatgagggctgaagttttcattagaatgcactcacactctgactgtacgtcctgatgaaaacccacttttggataattagaaccgtcaaggcttcattttctgtcaacagaattaggccgactgtcaggttaccttggcagggattccctgcaatcaaaaagatagatgataggtagcaattttggtccaaaatttttaatagtatacagacaacctgttaatttttttttttttttttttttttgtaaataacaaacaccactttgttatgaagaccttacaaacctcttcttaagacattcttactctgatccaggcaaaaacacttcaaggtttgtaaatgactctttcctgacataaatccttttttattaaaatgcaaaatgttcttcagaataaaactgtgtaataatttttatacttgggagtgctccttgcacagagctgtcatttgccagtgagagcctccgacagggcaggtactgtgccagggcagctctgaaattatggatattcttatcctcctggttccttcggtgccaatggtaacctaataccagccgcagggagcgccatttctcctaaagggctacaccactgtcaacattatcctggactctgtgtctctctctgttgggtcttgtggcatcacatcaggccaaaattgccagaccaggaccctaagtgtctgatagaggcgatgatcttttccaaagtcagtacttacaaactggcattcttacaggctgcaccatttcctagtatgtctgctttaagcctggttcaacctctcatcgaatattaaatttttctttgtaagaaaaa

SEQ ID NO: 113201 - DNA, 6414 bp, Homo sapiens
  Payload ID: 2139
  Gene Symbol: CACNA1D
  Gene Name: calcium channel, voltage-dependent, L type, alpha 1D subunit
  Uniprot ID: Q01668
  ENST ID: ENST00000422281
  CDS Start-End: 1-6414
atgatgatgatgatgatgatgaaaaaaatgcagcatcaacggcagcagcaagcggaccacgcgaacgaggcaaactatgcaagaggcaccagacttcctctttctggtgaaggaccaacttctcagccgaatagctccaagcaaactgtcctgtcttggcaagctgcaatcgatgctgctagacaggccaaggctgcccaaactatgagcacctctgcacccccacctgtaggatctctctcccaaagaaaacgtcagcaatacgccaagagcaaaaaacagggtaactcgtccaacagccgacctgcccgcgcccttttctgtttatcactcaataaccccatccgaagagcctgcattagtatagtggaatggaaaccatttgacatatttatattattggctatttttgccaattgtgtggccttagctatttacatcccattccctgaagatgattctaattcaacaaatcataacttggaaaaagtagaatatgccttcctgattatttttacagtcgagacatttttgaagattatagcgtatggattattgctacatcctaatgcttatgttaggaatggatggaatttactggattttgttatagtaatagtaggattgtttagtgtaattttggaacaattaaccaaagaaacagaaggcgggaaccactcaagcggcaaatctggaggctttgatgtcaaagccctccgtgcctttcgagtgttgcgaccacttcgactagtgtcaggagtgcccagtttacaagttgtcctgaactccattataaaagccatggttcccctccttcacatagcccttttggtattatttgtaatcataatctatgctattataggattggaactttttattggaaaaatgcacaaaacatgtttttttgctgactcagatatcgtagctgaagaggacccagctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaaggggtattttagtgacgcctggaacacgtttgactccctcatcgtaatcggcagcattatagacgtggccctcagcgaagcagacaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtag

SEQ ID NO: 113202 - DNA, 5667 bp, Homo sapiens
  Payload ID: 2139
  Gene Symbol: CACNA1D
  Gene Name: calcium channel, voltage-dependent, L type, alpha 1D subunit
  ENST ID: ENST00000481478
  CDS Start-End: 1-5565
gccaatggcacggaatgtaggagtggctgggttggcccgaacggaggcatcaccaactttgataactttgcctttgccatgcttactgtgtttcagtgcatcaccatggagggctggacagatgtgctctactggatgaatgatgctatgggatttgaattgccctgggtgtattttgtcagtctcgtcatctttgggtcatttttcgtactaaatcttgtacttggtgtattgagcggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatactagcatgcccaccagcgagactgagtctgtgaacacagagaacgtcagcggtgaaggcgagaaccgaggctgctgtggaagtctctggtgctggtggagacggagaggcgcggccaaggcggggccctctgggtgtcggcggtggggtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattggttgacacagattcaagatattgccaacaaagtcctcttggctctgttcacctgcgagatgctggtaaaaatgtacagcttgggcctccaagcatatttcgtctctcttttcaaccggtttgattgcttcgtggtgtgtggtggaatcactgagacgatcttggtggaactggaaatcatgtctcccctggggatctctgtgtttcggtgtgtgcgcctcttaagaatcttcaaagtgaccaggcactggacttccctgagcaacttagtggcatccttattaaactccatgaagtccatcgcttcgctgttgcttctgctttttctcttcattatcatcttttccttgcttgggatgcagctgtttggcggcaagtttaattttgatgaaacgcaaaccaagcggagcacctttgacaatttccctcaagcacttctcacagtgttccagatcctgacaggcgaagactggaatgctgtgatgtacgatggcatcatggcttacgggggcccatcctcttcaggaatgatcgtctgcatctacttcatcatcctcttcatttgtggtaactatattctactgaatgtcttcttggccatcgctgtagacaatttggctgatgctgaaagtctgaacactgctcagaaagaagaagcggaagaaaaggagaggaaaaagattgccagaaaagagagcctagaaaataaaaagaacaacaaaccagaagtcaaccagatagccaacagtgacaacaaggttacaattgatgactatagagaagaggatgaagacaaggacccctatccgccttgcgatgtgccagtaggggaagaggaagaggaagaggaggaggatgaacctgaggttcctgccggaccccgtcctcgaaggatctcggagttgaacatgaaggaaaaaattgcccccatccctgaagggagcgctttcttcattcttagcaagaccaacccgatccgcgtaggctgccacaagctcatcaaccaccacatcttcaccaacctcatccttgtcttcatcatgctgagcagcgctgccctggccgcagaggaccccatccgcagccactccttccggaacacgatactgggttactttgactatgccttcacagccatctttactgttgagatcctgttgaagatgacaacttttggagctttcctccacaaaggggccttctgcaggaactacttcaatttgctggatatgctggtggttggggtgtctctggtgtcatttgggattcaatccagtgccatctccgttgtgaagattctgagggtcttaagggtcctgcgtcccctcagggccatcaacagagcaaaaggacttaagcacgtggtccagtgcgtcttcgtggccatccggaccatcggcaacatcatgatcgtcaccaccctcctgcagttcatgtttgcctgtatcggggtccagttgttcaaggggaagttctatcgctgtacggatgaagccaaaagtaaccctgaagaatgcaggggacttttcatcctctacaaggatggggatgttgacagtcctgtggtccgtgaacggatctggcaaaacagtgatttcaacttcgacaacgtcctctctgctatgatggcgctcttcacagtctccacgtttgagggctggcctgcgttgctgtataaagccatcgactcgaatggagagaacatcggcccaatctacaaccaccgcgtggagatctccatcttcttcatcatctacatcatcattgtagctttcttcatgatgaacatctttgtgggctttgtcatcgttacatttcaggaacaaggagaaaaagagtataagaactgtgagctggacaaaaatcagcgtcagtgtgttgaatacgccttgaaagcacgtcccttgcggagatacatccccaaaaacccctaccagtacaagttctggtacgtggtgaactcttcgcctttcgaatacatgatgtttgtcctcatcatgctcaacacactctgcttggccatgcagcactacgagcagtccaagatgttcaatgatgccatggacattctgaacatggtcttcaccggggtgttcaccgtcgagatggttttgaaagtcatcgcatttaagcctaagcactatttcactgatgcatggaacacttttgatgccttaattgttgttggtagcgtcgttgatattgctataactgaagtgaatccaactgaaagtgaaaatgtccctgtcccaactgctacacctgggaactctgaagagagcaatagaatctccatcacctttttccgtcttttccgagtgatgcgattggtgaagcttctcagcaggggggaaggcatccggacattgctgtggacttttattaagtcctttcaggcgctcccgtatgtggccctcctcatagccatgctgttcttcatctatgcggtcattggcatgcagatgtttgggaaagttgccatgagagataacaaccagatcaataggaacaataacttccagacgtttccccaggcggtgctgctgctcttcaggtgtgcaacaggtgaggcctggcaggagatcatgctggcctgtctcccagggaagctctgtgaccctgagtcagattacaaccccggggaggagtatacatgtgggagcaactttgccattgtctatttcatcagtttttacatgctctgtgcatttctgatcatcaatctgtttgtggctgtcatcatggataatttcgactatctgacccgggactggtctattttggggcctcaccatttagatgaattcaaaagaatatggtcagaatatgaccctgaggcaaagggaaggataaaacaccttgatgtggtcactctgcttcgacgcatccagcctcccctggggtttgggaagttatgtccacacagggtagcgtgcaagagattagttgccatgaacatgcctctcaacagtgacgggacagtcatgtttaatgcaaccctgtttgctttggttcgaacggctcttaagatcaagaccgaagggaacctggagcaagctaatgaagaacttcgggctgtgataaagaaaatttggaagaaaaccagcatgaaattacttgaccaagttgtccctccagctggtgatgatgaggtaaccgtggggaagttctatgccactttcctgatacaggactactttaggaaattcaagaaacggaaagaacaaggactggtgggaaagtaccctgcgaagaacaccacaattgccctacaggcgggattaaggacactgcatgacattgggccagaaatccggcgtgctatatcgtgtgatttgcaagatgacgagcctgaggaaacaaaacgagaagaagaagatgatgtgttcaaaagaaatggtgccctgcttggaaaccatgtcaatcatgttaatagtgataggagagattcccttcagcagaccaataccacccaccgtcccctgcatgtccaaaggccttcaattccacctgcaagtgatactgagaaaccgctgtttcctccagcaggaaattcggtgtgtcataaccatcataaccataattccataggaaagcaagttcccacctcaacaaatgccaatctcaataatgccaatatgtccaaagctgcccatggaaagcggcccagcattgggaaccttgagcatgtgtctgaaaatgggcatcattcttcccacaagcatgaccgggagcctcagagaaggtccagtgtgaaaagaacccgctattatgaaacttacattaggtccgactcaggagatgaacagctcccaactatttgccgggaagacccagagatacatggctatttcagggacccccactgcttgggggagcaggagtatttcagtagtgaggaatgctacgaggatgacagctcgcccacctggagcaggcaaaactatggctactacagcagatacccaggcagaaacatcgactctgagaggccccgaggctaccatcatccccaaggattcttggaggacgatgactcgcccgtttgctatgattcacggagatctccaaggagacgcctactacctcccaccccagcatcccaccggagatcctccttcaactttgagtgcctgcgccggcagagcagccaggaagaggtcccgtcgtctcccatcttcccccatcgcacggccctgcctctgcatctaatgcagcaacagatcatggcagttgccggcctagattcaagtaaagcccagaagtactcaccgagtcactcgacccggtcgtgggccacccctccagcaacccctccctaccgggactggacaccgtgctacacccccctgatccaagtggagcagtcagaggccctggaccaggtgaacggcagcctgccgtccctgcaccgcagctcctggtacacagacgagcccgacatctcctaccggactttcacaccagccagcctgactgtccccagcagcttccggaacaaaaacagcgacaagcagaggagtgcggacagcttggtggaggcagtcctgatatccgaaggcttgggacgctatgcaagggacccaaaatttgtgtcagcaacaaaacacgaaatcgctgatgcctgtgacctcaccatcgacgagatggagagtgcagccagcaccctgcttaatgggaacgtgcgtccccgagccaacggggatgtgggccccctctcacaccggcaggactatgagctacaggactttggtcctggctacagcgacgaagagccagaccctgggagggatgaggaggacctggcggatgaaatgatatgcatcaccaccttgtagcccccagcgaggggcagactggctctggcctcaggtggggcgcaggagagccaggggaaaagtgcctcatagttaggaaagtttaggcactagttgggagta

SEQ ID NO: 113203 - DNA, 791 bp, Homo sapiens
  Payload ID: 2139
  Gene Symbol: CACNA1D
  Gene Name: calcium channel, voltage-dependent, L type, alpha 1D subunit
  ENST ID: ENST00000481085
  CDS Start-End: 1-791
ctccatgtgcgttctcagggaatggacgccagtgtactgccaatggcacggaatgtaggagtggctgggttggcccgaacggaggcatcaccaactttgataactttgcctttgccatgcttactgtgtttcagtgcatcaccatggagggctggacagatgtgctctactgggtaaatgatgcgataggatgggaatggccatgggtgtattttgttagtctgatcatccttggctcatttttcgtccttaacctggttcttggtgtccttagtggagaattctcaaaggaaagagagaaggcaaaagcacggggagatttccagaagctccgggagaagcagcagctggaggaggatctaaagggctacttggattggatcacccaagctgaggacatcgatccggagaatgaggaagaaggaggagaggaaggcaaacgaaatagggtcacagtggccgacttgcttaaagaggataagaagaaaaagaagttttgctgctttcggcaacgcagggctaaagatcatgctagcatgcccaccagcgagactgagtctgtgaacacagagaacgtcagcggtgaaggcgagaaccgaggctgctgtggaagtctctgtcaagccatctcaaaatccaaactcagccgacgctggcgtcgctggaaccgattcaatcgcagaagatgtagggccgccgtgaagtctgtcacgttttactggctggttatcgtcctggtgtttctgaacaccttaaccatttcctctgagcactacaatcagccagattgg

SEQ ID NO: 113204 - DNA, 6037 bp, Homo sapiens
  Payload ID: 2140
  Gene Symbol: CACNA1F
  Gene Name: calcium channel, voltage-dependent, L type, alpha 1F subunit
  Uniprot ID: O60840
  ENST ID: ENST00000323022
  CDS Start-End: 63-5963
ctccaaagctgggggaagagaggggggttgtgtgcagatggcccttcaatctcgaaagaaagatgtcggaatctgaaggcgggaaagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttgggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggtgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccacggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 113205 - DNA, 5813 bp, Homo sapiens
  Payload ID: 2140
  Gene Symbol: CACNA1F
  Gene Name: calcium channel, voltage-dependent, L type, alpha 1F subunit
  Uniprot ID: O60840
  ENST ID: ENST00000376251
  CDS Start-End: 1-5739
atgtcggaatctgaaggcgggaaaggtgagagaatccttccatccctgcagacccttggagcaagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggtgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccacggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 113206 - DNA, 6070 bp, Homo sapiens
  Payload ID: 2140
  Gene Symbol: CACNA1F
  Gene Name: calcium channel, voltage-dependent, L type, alpha 1F subunit
  Uniprot ID: O60840
  ENST ID: ENST00000376265
  CDS Start-End: 63-5996
ctccaaagctgggggaagagaggggggttgtgtgcagatggcccttcaatctcgaaagaaagatgtcggaatctgaaggcgggaaagacaccaccccagagcccagtccagccaatggggcaggccctggtcccgaatgggggctgtgccccgggcccccagctgtggaaggtgaaagcagtggggcatcaggcctagggacccctaagcgaagaaaccagcacagcaagcacaagacagtggcagtggccagtgcccagcggtcacctcgggcactcttctgcctcaccctggccaatcctctgcgacggtcctgcatcagcatcgtggagtggaagcccttcgacatcctcatcctgctgaccatctttgccaactgcgtggccctgggagtttacatccccttccctgaggacgactccaacactgccaaccacaacctggagcaggtggagtacgtattcctggtgattttcactgtggagacggtgctcaagatcgtggcctacgggctggtgctccaccccagcgcctacatccgcaatggctggaacctactcgacttcatcatcgtcgtggtcgggctgttcagcgttctgctggagcagggccccggacggccaggcgacgccccgcacaccgggggaaagccaggaggcttcgatgtgaaggcattgagggcgtttcgggtgctgcggccactgaggctggtgtctggggtcccgagcctgcacatagtgctcaattccatcatgaaggctctggtgccgctgctgcacattgcactgctcgtgctcttcgtcatcatcatttatgccatcattgggctcgagctgttccttggacgaatgcacaagacgtgctacttcctgggatccgacatggaagcggaggaggacccatcgccctgtgcgtcttcgggatcagggcgtgcgtgcacgctgaaccagactgagtgccgcgggcgctggccagggcccaatggaggcatcaccaactttgacaacttcttcttcgccatgctgacagtcttccagtgtgtcaccatggaaggctggaccgatgtgctctactggatgcaagatgccatggggtatgaactgccctgggtgtactttgtgagccttgtcatctttgggtccttcttcgtcctcaaccttgtgcttggcgtcctgagtggggagttctccaaggagagagagaaagcgaaagctcgcggggacttccagaagcagcgggagaagcagcagatggaggaagacctgcggggctacctggactggatcactcaagccgaagagctggacatggaggacccctccgccgatgacaaccttggttctatggctgaagagggccgggcgggccatcggccacagctggccgagctgaccaataggaggcgtggacgtctgcgctggttcagtcattctactcgctccacacactccaccagcagccatgccagcctcccagccagtgacaccggttccatgacagagacccaaggcgatgaggatgaggaggagggggctctggccagctgtacacgctgcctaaacaagatcatgaaaaccagagtctgccgccgcctccgccgagccaaccgggtccttcgggcacgctgccgtcgggcagtgaagtccaatgcctgctactgggctgtgctgttgctcgtcttcctcaacacgttgaccatcgcctctgagcaccacgggcagcctgtgtggctcacccagatccaggagtatgccaacaaagtgttgctctgtctgttcacggtggagatgcttctcaaattgtacggtctgggcccctctgcctatgtgtcttccttcttcaaccgctttgactgctttgtggtctgtgggggcatcctagagaccaccttggtggaggtgggtgccatgcagcccttgggcatctcagtgctccgatgtgtgcgcctcctcaggatctttaaggtcaccagacactgggcttctctgagcaatctggtggcatccctgctcaattcaatgaaatccatcgcatccttgctgcttctcctcttcctcttcatcattatcttctccctgcttggcatgcagctgtttgggggcaagttcaactttgaccagacccacaccaagcgaagcacctttgacacgttcccccaggccctcctcactgtctttcagatcctgacaggtgaggactggaacgtggtcatgtatgatggtatcatggcatatggtggccccttcttcccaggaatgttggtgtgcatctatttcatcattctcttcatctgtggcaactacatcctgttgaacgtgtttcttgccattgctgtggacaacctggccagtggagatgcaggcactgccaaggacaagggcggggagaagagcaatgagaaggatctcccacaggagaatgaaggcctggtgcctggtgtggagaaagaggaagaggagggtgcaaggagggaaggagcagacatggaggaggaggaggaggaggaagaagaggaagaagaggaagaagaggaagagggtgcagggggtgtggaactcctgcaggaagttgtacccaaggagaaggtggtacccatccctgagggcagcgccttcttctgcctcagccaaaccaacccgctgaggaagggctgccacaccctcatccaccatcatgtcttcaccaatcttatcctggtgttcatcatcctcagcagtgtgtccctggccgctgaggaccccatccgagcccactccttccgcaaccatattctgggttacttcgattatgccttcacctccattttcactgtggagattctactaaagatgacagtgtttggggccttcctgcaccgcggctccttctgccgtagctggtttaatatgttggatctgctggtggtcagtgtgtccctcatctcctttggcatccactccagcgccatctcggtggtgaagattctgcgagtactccgagtactgcggcccctccgagccatcaacagggccaagggactcaagcatgtggtgcagtgtgtatttgtggccatccggaccatcggaaacatcatgattgtcaccacacttctgcaatttatgttcgcctgcatcggggtgcagctcttcaaggggaaattctacacctgcacggacgaggccaaacacacccctcaagaatgcaagggctccttcctggtatacccagatggagacgtgtcacggcccctggtccgggagcggctctgggtcaacagtgatttcaactttgacaatgtcctttcagccatgatggccctgttcactgtctccacctttgaaggctggcctgcactgctatacaaggccatcgatgcatatgcagaggaccacggccccatctataattaccgtgtggagatctcagtgttcttcattgtctacatcatcatcattgcgttcttcatgatgaacatcttcgtgggcttcgtcatcatcactttccgtgcccagggcgagcaggagtaccaaaactgtgagctggacaagaaccagcgtcaatgtgtggaatatgccctcaaggcccagccactccgccgttacatccccaagaacccgcatcagtatcgtgtgtgggccactgtgaactctgctgcctttgagtacctgatgttcctgctcatcctgctcaacacagttgccctagccatgcagcactatgagcagactgctcccttcaactatgccatggacatcctcaacatggtcttcactggcctcttcactattgagatggtgctcaaaatcatcgccttcaagcccaagcattacttcactgatgcctggaacacgtttgacgctcttattgtggtgggcagcatagtggatattgccgtcactgaagtcaataatggtggccaccttggcgagagctctgaggacagctcccgcatttccattaccttctttcgcctcttccgagttatgcggctggtcaagcttctcagtaagggtgaagggatccgcacattgctctggacattcatcaagtccttccaggccttgccctatgtggctcttctcatcgcaatgatattcttcatctatgccgtcattggcatgcagatgttcggcaaggtggctcttcaggatggcacacagataaaccgaaacaacaacttccagacctttccacaggctgtgctgcttctgttcaggtgtgccactggtgaggcatggcaggagataatgcttgccagccttcccggaaatcggtgtgatcctgagtctgacttcggccctggtgaagagtttacctgtggtagcaattttgccatcgcctatttcatcagcttcttcatgctctgtgccttcctgatcataaatctctttgtggctgtgatcatggacaactttgattatctcaccagagattggtccatcctgggcccccatcaccttgatgaattcaagaggatctggtctgaatatgaccctggggccaagggccgcatcaaacacttggatgtggttgccctgctgagacgtatccagccccctctgggatttgggaagctgtgcccacaccgagtggcctgcaagagacttgtggcaatgaacatgcccctcaactcagatgggacggtgacattcaacgccacactctttgccctggtccggacatccctgaagatcaaaacagaagggaacctggagcaagccaaccaggagctgcggattgtcatcaaaaagatctggaagcggatgaaacagaagctgctagatgaggtcatccccccaccagacgaggaggaggtcaccgtgggcaaattctacgccacatttctgatccaggactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagccacgatggtctcccagccctcagctcgccggggctccgggatttctgtgtctctgcctgtcggggacagacttccagattcactctcctttgggcccagtgatgatgacagggggactcccacctccagtcagcccagtgtgccccaggctggatccaacacccacaggagaggctctggggctctcattttcaccatcccagaagaaggaaattctcagcccaagggaaccaaagggcaaaacaagcaagatgaggatgaggaagtccctgatcggctttcctacctagatgagcaggcagggactcccccgtgctcagtccttttgccacctcacagagctcagagatacatggatgggcacctggtaccacgccgccgtctgctgccccccacacctgcaggtcggaagccctccttcaccatccagtgtctgcagcgccagggcagttgtgaggatttacccatcccaggcacctatcatcgtgggcgaaattcagggcccaatagggctcagggttcctgggcaacaccacctcagcggggtcggctcctgtatgccccgctgttgttggtggaagagggcgcagcgggggaggggtacctcggcagatccagtggcccactgcgcaccttcacctgtctgcacgtgcctggaacccactcggaccccagccatgggaagaggggcagtgccgacagcttggtggaggctgtgcttatctcagagggtctgggcctctttgctcgagacccacgtttcgtggccctggccaagcaggagattgcagatgcgtgtcgcctgacgctggatgagatggacaatgctgccagtgacctgctggcacagggaaccagctctctctatagcgacgaggagtccatcctctcccgcttcgatgaggaggacttgggagacgagatggcctgcgtccacgccctctgaattcccacccctccccaactgctcaataaacctcctgccctcccctccccagcaggaggcaggcatggaccaca

SEQ ID NO: 113207 - DNA, 662 bp, Homo sapiens
  Payload ID: 2140
  Gene Symbol: CACNA1F
  Gene Name: calcium channel, voltage-dependent, L type, alpha 1F subunit
  ENST ID: ENST00000486943
  CDS Start-End: 1-351
gactatttccgcaaattccggcggaggaaagaaaaagggctactaggcaacgacgccgcccctagcacctcttccgcccttcaggctggtctgcggagcctgcaggacttgggtcctgagatgcggcaggccctcacctgtgacacagaggaggaggaagaagaggggcaggagggagtggaggaggaagatgaaaaggacttggaaactaacaaagtggggacaagttttcactctcccaggaacttgattgtaaaatacttcgtcaatcccctgagtgattttgacactgcttctgggaagaagctcccccagagaagccccctctgcaatagaaaaatatttatttgaggctgggagtggtggctcatgcctataatcccagcactttgggagtccagggtggaaggatcgcttgaaccctagggttcaagaccagtcctggcaaaatagtgaaaccgcctctctacaaaaaaatttaaaaattagctaggagtggtggtgcaagcctgtagtcccagctacttgggaggctgaggcaggaggattgcttgaacctgggaggatgaggccacagtgagctgtgatcatgccactgcactcccgcctggtgacaggacaagaccctatcgcaaatatttatttatttatttacgtattta

SEQ ID NO: 113208 - DNA, 6166 bp, Homo sapiens
  Payload ID: 2141
  Gene Symbol: CACNA1S
  Gene Name: calcium channel, voltage-dependent, L type, alpha 1S subunit
  Uniprot ID: Q13698
  ENST ID: ENST00000362061
  CDS Start-End: 228-5849
tcaggcccggcagcggggagccgagtggaggctaattttacttgctgggagcgaggagagtaatcctcctgcccccactcctgcccccgccccctggctggctcagcagggcaggctcagccgacagcctcagccagcctagtccccaaggcgggggcattggggacacagggaagggaaagcactggggtgggggagcaggagaaagccagattcccagggaagccatggagccatcctcaccccaggatgaaggcctgaggaagaaacagcccaagaagccagttcctgagattctgccaaggccaccccgggccttgttctgcctgaccctggagaaccccctgaggaaggcctgcatcagcattgtagaatggaagcccttcgagacgatcatcttgctcaccatctttgccaattgtgtggccctggccgtgtacctgcccatgccggaagatgacaacaactctctgaacctcggcctggagaagctggagtatttcttcctcattgtcttctcgattgaagccgccatgaagatcattgcctacggcttcttattccaccaggacgcttacctgcgcagtggctggaatgtgctggacttcaccattgtcttcctgggggtcttcaccgtgattctggaacaggttaacgtcatccaaagccacacagccccaatgagcagcaaaggagccggcttggatgtcaaggccctcagagccttccgagtgctcagacccctccggctggtgtcgggggtgcctagcctgcaggtggtcctgaactccatcttcaaggccatgctccccctctttcacatcgccctgctggtcctctttatggtcatcatctatgccatcatcgggctggagctcttcaagggcaagatgcacaagacctgctacttcattggtacagatatcgtggccacggtggagaatgaagagccatcgccctgcgccaggacgggctcagggcgccggtgcaccatcaatggcagtgagtgccggggcggctggccagggcccaaccatggcatcacccacttcgacaacttcggcttctccatgctcaccgtgtaccagtgcattaccatggagggatggactgacgtcctttactgggtcaatgatgccatcgggaatgagtggccctggatctattttgtcaccctcattttgctgggatccttcttcatcctcaacctggtgctgggtgtcctgagtggggaattcaccaaggagcgggagaaggccaagtccaggggaaccttccagaagctccgggagaagcagcaactagatgaggaccttcggggctacatgagctggatcacgcagggcgaggtcatggatgttgaggacttcagagaaggaaaactgtctttggatgaaggtggctctgacacagagagcctgtatgaaattgcaggcttgaacaaaatcatccagttcatccgacattggaggcagtggaaccgcatctttcgctggaagtgccatgacatcgtgaagtccaaggtcttctattggctggtgattctcatcgttgccctcaacaccctgtctatcgcctcagagcaccacaaccagcctctctggctgacccgtttgcaagacattgccaaccgggtgctgctgtccctcttcaccactgagatgctgatgaagatgtacgggctgggcctgcgccagtacttcatgtctatcttcaaccgcttcgactgcttcgtggtgtgtagcggtatcctggagatcctgctggtggagtcgggtgccatgacacccctgggcatctccgtgctccgctgcatccgcctcctgaggatcttcaagatcaccaaatattggacgtcgctgagcaacctggtggcatccctgctcaactccatccgctccatcgcctccctgctgctgctgctcttcctcttcatcgtcatcttcgccctcctgggcatgcagctctttggggggaggtatgactttgaagacacagaagtacggcgcagcaactttgacaactttccccaagccctcatcagcgtcttccaggtactgacaggggaagactggacctcaatgatgtacaatgggatcatggcctacggcgggccgtcctaccctggcatgcttgtgtgcatttacttcatcatccttttcgtctgtggcaactacatcctgctcaatgtcttcctggccattgccgtggacaacctggccgaggcggagagcctgacttctgcccagaaggccaaggctgaggagaaaaaacgcaggaagatgtccaagggtctcccagacaagtcagaagaggagaagtcaacgatggccaagaagctggagcagaaacccaagggtgagggcatccccaccactgccaagctgaaaatcgatgagtttgaatctaatgtcaatgaggtgaaggatccctacccctcagccgacttcccaggggatgacgaggaagatgagcctgagatcccgctgagcccccgaccacgtcccctggctgagctgcagctgaaagagaaggccgtgcccattccagaagccagctccttcttcatcttcagccccaccaataagatccgtgtcctgtgtcaccgcatcgtcaatgccacctggtttaccaacttcatcctgctcttcatcctgctcagcagcgctgcactggctgcggaagaccccatccgggctgattccatgagaaatcagatccttaaacactttgacatcgggttcacctctgtcttcactgtggagattgtcctcaagatgacgacctacggagccttcctgcacaagggttccttctgccgcaattacttcaacatgctggacctgctggtggtggccgtgtccctcatctccatgggacttgagtccagtgccatctccgtggtgaagatcctgagggtgctgagggtgctccgaccactcagagccatcaacagagccaaggggttgaagcacgtggtgcagtgcatgttcgtggccatcagcaccatcgggaacatcgtgctggtcactaccctcctacagttcatgtttgcctgcatcggcgtccagctcttcaaggggaagttcttcaggtgcaccgacttgtccaagatgacagaggaggagtgcaggggctactactacgtgtacaaggacggggaccccatgcagatagagctgcgtcaccgcgagtgggtacacagcgacttccacttcgacaatgtgctctcagccatgatgtccctcttcacggtctccaccttcgagggatggcctcagctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcagcactacaaccagtcggagcagatgaaccacatctcagacatcctcaatgtggccttcactatcatcttcaccctggagatgatcctcaagctcatggccttcaaggccaggggctactttggagacccctggaatgtgtttgacttcctgattgtcattggcagcatcattgatgtcatcctcagtgagatcgacactttcctggcctccagcgggggactgtattgcctgggtggaggctgcgggaacgttgacccagatgagagtgcccgcatctccagcgccttcttccgcctgttccgtgtcatgaggctgatcaagctgctgagccgggcagaaggagtgcgaaccctcctgtggacgttcatcaagtccttccaggccctaccctacgtggctctgctcatcgtcatgctcttcttcatctacgctgtcatcggcatgcagatgtttgggaagatcgccttggtggatgggacccaaataaaccggaacaacaacttccagaccttcccacaagctgtgctactgctcttcaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtcatcaacctctttgtggctgtcatcatggacaattttgactacctcacccgggactggtccatcctgggccctcatcacctggatgagttcaaggccatctgggcagagtatgacccagaggctaaggggagaatcaaacacctggacgtggtgaccctgctgagaaggattcagccccctctgggctttgggaagttctgcccacatcgggtagcttgtaagcggctggtgggcatgaacatgcccctgaacagcgacggcacagtcaccttcaatgccacactctttgccctggtccgcacggcactcaagatcaagacggaaggtaactttgagcaggccaacgaggagctgagggccatcatcaagaagatctggaagagaaccagcatgaagctcttggaccaggtcatccctccaataggagatgatgaggtgacagtggggaagttctacgccacattcctcatccaggagcacttccggaagttcatgaaacgccaagaggagtattatggctatcggcccaagaaggacattgtacagatccaggcagggctgcggaccattgaggaagaggcagcccccgagatctgtcgcacggtctcaggagacctggctgctgaggaggagctggagagagccatggtggaggctgcgatggaggagggaatattccggaggactggaggcctgtttggccaggtggacaacttcctggaaaggaccaactccctgccccccgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatggcaacagcaaccatagcaacagccatgtgttttccagtgtccactatgaaagggagttcccagaagagacagagacgcctgctaccagaggacgagcccttggccaaccctgcagggtcctgggaccccacagcaaaccctgtgtggagatgctgaagggactgctgacccagagggcaatgcccagaggccaggcacctcctgccccctgccagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggctctggttcgagggggcctgggcaccttggcagctgatgcaaacttcatcatggcaacaggccaggccctggcagatgcctgccaaatggaaccagaggaagtggagatcatggcaacagagctactgaaaggacgagaggccccagagggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatggcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtctggcctagggccactcccacctgcaggacattaaaatctccaggcctgtgacactggc

SEQ ID NO: 113209 - DNA, 5996 bp, Homo sapiens
  Payload ID: 2141
  Gene Symbol: CACNA1S
  Gene Name: calcium channel, voltage-dependent, L type, alpha 1S subunit
  ENST ID: ENST00000367338
  CDS Start-End: 113-5677
ctcagccgacagcctcagccagcctagtccccaaggcgggggcattggggacacagggaagggaaagcactggggtgggggagcaggagaaagccagattcccagggaagccatggagccatcctcaccccaggatgaaggcctgaggaagaaacagcccaagaagccagttcctgagattctgccaaggccaccccgggccttgttctgcctgaccctggagaaccccctgaggaaggcctgcatcagcattgtagaatggaagcccttcgagacgatcatcttgctcaccatctttgccaattgtgtggccctggccgtgtacctgcccatgccggaagatgacaacaactctctgaacctcggcctggagaagctggagtatttcttcctcattgtcttctcgattgaagccgccatgaagatcattgcctacggcttcttattccaccaggacgcttacctgcgcagtggctggaatgtgctggacttcaccattgtcttcctgggggtcttcaccgtgattctggaacaggttaacgtcatccaaagccacacagccccaatgagcagcaaaggagccggcttggatgtcaaggccctcagagccttccgagtgctcagacccctccggctggtgtcgggggtgcctagcctgcaggtggtcctgaactccatcttcaaggccatgctccccctctttcacatcgccctgctggtcctctttatggtcatcatctatgccatcatcgggctggagctcttcaagggcaagatgcacaagacctgctacttcattggtacagatatcgtggccacggtggagaatgaagagccatcgccctgcgccaggacgggctcagggcgccggtgcaccatcaatggcagtgagtgccggggcggctggccagggcccaaccatggcatcacccacttcgacaacttcggcttctccatgctcaccgtgtaccagtgcattaccatggagggatggactgacgtcctttactgggtcaatgatgccatcgggaatgagtggccctggatctattttgtcaccctcattttgctgggatccttcttcatcctcaacctggtgctgggtgtcctgagtggggaattcaccaaggagcgggagaaggccaagtccaggggaaccttccagaagctccgggagaagcagcaactagatgaggaccttcggggctacatgagctggatcacgcagggcgaggtcatggatgttgaggacttcagagaaggaaaactgtctttggatgaaggtggctctgacacagagagcctgtatgaaattgcaggcttgaacaaaatcatccagttcatccgacattggaggcagtggaaccgcatctttcgctggaagtgccatgacatcgtgaagtccaaggtcttctattggctggtgattctcatcgttgccctcaacaccctgtctatcgcctcagagcaccacaaccagcctctctggctgacccgtttgcaagacattgccaaccgggtgctgctgtccctcttcaccactgagatgctgatgaagatgtacgggctgggcctgcgccagtacttcatgtctatcttcaaccgcttcgactgcttcgtggtgtgtagcggtatcctggagatcctgctggtggagtcgggtgccatgacacccctgggcatctccgtgctccgctgcatccgcctcctgaggatcttcaagatcaccaaatattggacgtcgctgagcaacctggtggcatccctgctcaactccatccgctccatcgcctccctgctgctgctgctcttcctcttcatcgtcatcttcgccctcctgggcatgcagctctttggggggaggtatgactttgaagacacagaagtacggcgcagcaactttgacaactttccccaagccctcatcagcgtcttccaggtactgacaggggaagactggacctcaatgatgtacaatgggatcatggcctacggcgggccgtcctaccctggcatgcttgtgtgcatttacttcatcatccttttcgtctgtggcaactacatcctgctcaatgtcttcctggccattgccgtggacaacctggccgaggcggagagcctgacttctgcccagaaggccaaggctgaggagaaaaaacgcaggaagatgtccaagggtctcccagacaagtcagaagaggagaagtcaacgatggccaagaagctggagcagaaacccaagggtgagggcatccccaccactgccaagctgaaaatcgatgagtttgaatctaatgtcaatgaggtgaaggatccctacccctcagccgacttcccaggggatgacgaggaagatgagcctgagatcccgctgagcccccgaccacgtcccctggctgagctgcagctgaaagagaaggccgtgcccattccagaagccagctccttcttcatcttcagccccaccaataagatccgtgtcctgtgtcaccgcatcgtcaatgccacctggtttaccaacttcatcctgctcttcatcctgctcagcagcgctgcactggctgcggaagaccccatccgggctgattccatgagaaatcagatccttaaacactttgacatcgggttcacctctgtcttcactgtggagattgtcctcaagatgacgacctacggagccttcctgcacaagggttccttctgccgcaattacttcaacatgctggacctgctggtggtggccgtgtccctcatctccatgggacttgagtccagtgccatctccgtggtgaagatcctgagggtgctgagggtgctccgaccactcagagccatcaacagagccaaggggttgaagcacgtggtgcagtgcatgttcgtggccatcagcaccatcgggaacatcgtgctggtcactaccctcctacagttcatgtttgcctgcatcggcgtccagctcttcaaggggaagttcttcaggtgcaccgacttgtccaagatgacagaggaggagtgcaggggctactactacgtgtacaaggacggggaccccatgcagatagagctgcgtcaccgcgagtgggtacacagcgacttccacttcgacaatgtgctctcagccatgatgtccctcttcacggtctccaccttcgagggatggcctcagctgctgtacaaggccatagactccaatgcggaggacgtgggtcccatctacaacaaccgtgtggagatggccatcttcttcatcatctacatcatcctcattgccttcttcatgatgaacatctttgtgggcttcgtcattgtcaccttccaggagcagggagagactgagtacaagaactgtgagctggacaagaaccagcgccaatgtgtacagtatgccctgaaggcccgcccactgaggtgctacattcccaaaaacccataccagtaccaggtgtggtacattgtcacctcctcctactttgaatacctgatgtttgccctcatcatgctcaacaccatctgcctcggcatgcagcactacaaccagtcggagcagatgaaccacatctcagacatcctcaatgtggccttcactatcatcttcaccctggagatgatcctcaagctcatggccttcaaggccaggggctactttggagacccctggaatgtgtttgacttcctgattgtcattggcagcatcattgatgtcatcctcagtgagatcgacgacccagatgagagtgcccgcatctccagcgccttcttccgcctgttccgtgtcatgaggctgatcaagctgctgagccgggcagaaggagtgcgaaccctcctgtggacgttcatcaagtccttccaggccctaccctacgtggctctgctcatcgtcatgctcttcttcatctacgctgtcatcggcatgcagatgtttgggaagatcgccttggtggatgggacccaaataaaccggaacaacaacttccagaccttcccacaagctgtgctactgctcttcaggtgtgcaacaggtgaggcctggcaggagatcctactggcctgcagctatgggaagctgtgtgacccagagtcggactatgccccaggggaggagtacacatgtggcaccaactttgcatactactacttcatcagcttctacatgctctgtgccttcctggtcatcaacctctttgtggctgtcatcatggacaattttgactacctcacccgggactggtccatcctgggccctcatcacctggatgagttcaaggccatctgggcagagtatgacccagaggctaaggggagaatcaaacacctggacgtggtgaccctgctgagaaggattcagccccctctgggctttgggaagttctgcccacatcgggtagcttgtaagcggctggtgggcatgaacatgcccctgaacagcgacggcacagtcaccttcaatgccacactctttgccctggtccgcacggcactcaagatcaagacggaaggtaactttgagcaggccaacgaggagctgagggccatcatcaagaagatctggaagagaaccagcatgaagctcttggaccaggtcatccctccaataggagatgatgaggtgacagtggggaagttctacgccacattcctcatccaggagcacttccggaagttcatgaaacgccaagaggagtattatggctatcggcccaagaaggacattgtacagatccaggcagggctgcggaccattgaggaagaggcagcccccgagatctgtcgcacggtctcaggagacctggctgctgaggaggagctggagagagccatggtggaggctgcgatggaggagggaatattccggaggactggaggcctgtttggccaggtggacaacttcctggaaaggaccaactccctgccccccgtcatggccaatcagagacccctccagtttgctgagatagagatggaagagatggagtcacctgtcttcttggaggacttcccacaagatccacgcaccaaccccctggctcgtgccaataccaacaatgccaacgccaatgtcgcctatggcaacagcaaccatagcaacagccatgtgttttccagtgtccactatgaaagggagttcccagaagagacagagacgcctgctaccagaggacgagcccttggccaaccctgcagggtcctgggaccccacagcaaaccctgtgtggagatgctgaagggactgctgacccagagggcaatgcccagaggccaggcacctcctgccccctgccagtgccccagggtggagtcctccatgcctgaggacagaaagagctccacaccagggtctcttcatgaggagacaccccacagcaggagcaccagggagaatacttccaggtgctcagcaccagctacagccctgctgatccaaaaggctctggttcgagggggcctgggcaccttggcagctgatgcaaacttcatcatggcaacaggccaggccctggcagatgcctgccaaatggaaccagaggaagtggagatcatggcaacagagctactgaaaggacgagaggccccagagggcatggccagctccctgggatgcctgaacctcgggtcctccctgggcagcctcgaccaacaccagggctcccaggagacccttattcctccaaggctgtgatgcccacacagcatcagcatgggcttagagctggcatgaccaatgggggtggggaagttgctggggtggagaagggctagcccaccgcagcagcctccctccctctcagcagctagatgcatggcctgaggcagggtggtcaggaaccacctcaaaaagtgcggaggaagtagctggacaggccctgcccctcaccagcaagaggcatgattggatggagcttctaatgtcattcaaaaaggcctggtcagtgcctgtctggcctagggccactcccacctgcaggacattaaaatctccaggcctgtgacactggcaa

SEQ ID NO: 113210 - DNA, 7158 bp, Homo sapiens
  Payload ID: 2142
  Gene Symbol: CACNA1B
  Gene Name: calcium channel, voltage-dependent, N type, alpha 1B subunit
  ENST ID: ENST00000277549
  CDS Start-End: 146-6859
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggtaaagaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgtt

SEQ ID NO: 113211 - DNA, 7158 bp, Homo sapiens
  Payload ID: 2142
  Gene Symbol: CACNA1B
  Gene Name: calcium channel, voltage-dependent, N type, alpha 1B subunit
  Uniprot ID: Q00975
  ENST ID: ENST00000277551
  CDS Start-End: 146-6859
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgtt

SEQ ID NO: 113212 - DNA, 9647 bp, Homo sapiens
  Payload ID: 2142
  Gene Symbol: CACNA1B
  Gene Name: calcium channel, voltage-dependent, N type, alpha 1B subunit
  ENST ID: ENST00000371355
  CDS Start-End: 1-7023
atggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggccaccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgcagtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccc

SEQ ID NO: 113213 - DNA, 9642 bp, Homo sapiens
  Payload ID: 2142
  Gene Symbol: CACNA1B
  Gene Name: calcium channel, voltage-dependent, N type, alpha 1B subunit
  ENST ID: ENST00000371357
  CDS Start-End: 1-7017
atggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgcagtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 113214 - DNA, 9758 bp, Homo sapiens
  Payload ID: 2142
  Gene Symbol: CACNA1B
  Gene Name: calcium channel, voltage-dependent, N type, alpha 1B subunit
  ENST ID: ENST00000371363
  CDS Start-End: 120-7133
gggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 113215 - DNA, 9790 bp, Homo sapiens
  Payload ID: 2142
  Gene Symbol: CACNA1B
  Gene Name: calcium channel, voltage-dependent, N type, alpha 1B subunit
  Uniprot ID: Q00975
  ENST ID: ENST00000371372
  CDS Start-End: 146-7165
gcggcggcggctgcggcggtggggccgggcgaggtccgctgcggtcccggcggctccgtggctgctccgctctgagcgcctggcgcgccccgcgccctccctgccggggccgctgggccggggatgcacgcggggcccgggagccatggtccgcttcggggacgagctgggcggccgctatgggggccccggcggcggagagcgggcccggggcggcggggccggcggggcggggggcccgggtcccggggggctgcagcccggccagcgggtcctctacaagcaatcgatcgcgcagcgcgcgcggaccatggcgctgtacaaccccatcccggtcaagcagaactgcttcaccgtcaaccgctcgctcttcgtcttcagcgaggacaacgtcgtccgcaaatacgcgaagcgcatcaccgagtggcctccattcgagtatatgatcctggccaccatcatcgccaactgcatcgtgctggccctggagcagcacctccctgatggggacaaaacgcccatgtccgagcggctggacgacacggagccctatttcatcgggatcttttgcttcgaggcagggatcaaaatcatcgctctgggctttgtcttccacaagggctcttacctgcggaacggctggaacgtcatggacttcgtggtcgtcctcacagggatccttgccacggctggaactgacttcgacctgcgaacactgagggctgtgcgtgtgctgaggcccctgaagctggtgtctgggattccaagtttgcaggtggtgctcaagtccatcatgaaggccatggttccactcctgcagattgggctgcttctcttctttgccatcctcatgtttgccatcattggcctggagttctacatgggcaagttccacaaggcctgtttccccaacagcacagatgcggagcccgtgggtgacttcccctgtggcaaggaggccccagcccggctgtgcgagggcgacactgagtgccgggagtactggccaggacccaactttggcatcaccaactttgacaatatcctgtttgccatcttgacggtgttccagtgcatcaccatggagggctggactgacatcctctataatacaaacgatgcggccggcaacacctggaactggctctacttcatccctctcatcatcatcggctccttcttcatgctcaacctggtgctgggcgtgctctcgggggagtttgccaaggagcgagagagggtggagaaccgccgcgccttcctgaagctgcgccggcagcagcagatcgagcgagagctcaacgggtacctggagtggatcttcaaggcggaggaagtcatgctggccgaggaggacaggaatgcagaggagaagtcccctttggacgtgctgaagagagcggccaccaagaagagcagaaatgacctgatccacgcagaggagggagaggaccggtttgcagatctctgtgctgttggatcccccttcgcccgcgccagcctcaagagcgggaagacagagagctcgtcatacttccggaggaaggagaagatgttccggttttttatccggcgcatggtgaaggctcagagcttctactgggtggtgctgtgcgtggtggccctgaacacactgtgtgtggccatggtgcattacaaccagccgcggcggcttaccacgaccctgtattttgcagagtttgttttcctgggtctcttcctcacagagatgtccctgaagatgtatggcctggggcccagaagctacttccggtcctccttcaactgcttcgactttggggtcatcgtggggagcgtctttgaagtggtctgggcggccatcaagccgggaagctcctttgggatcagtgtgctgcgggccctccgcctgctgaggatcttcaaagtcacgaagtactggagctccctgcggaacctggtggtgtccctgctgaactccatgaagtccatcatcagcctgctcttcttgctcttcctgttcattgtggtcttcgccctgctggggatgcagctgtttgggggacagttcaacttccaggatgagactcccacaaccaacttcgacaccttccctgccgccatcctcactgtcttccagatcctgacgggagaggactggaatgcagtgatgtatcacgggatcgaatcgcaaggcggcgtcagcaaaggcatgttctcgtccttttacttcattgtcctgacactgttcggaaactacactctgctgaatgtctttctggccatcgctgtggacaacctggccaacgcccaagagctgaccaaggatgaagaggagatggaagaagcagccaatcagaagcttgctctgcaaaaggccaaagaagtggctgaagtcagccccatgtctgccgcgaacatctccatcgccgccaggcagcagaactcggccaaggcgcgctcggtgtgggagcagcgggccagccagctacggctgcagaacctgcgggccagctgcgaggcgctgtacagcgagatggaccccgaggagcggctgcgcttcgccactacgcgccacctgcggcccgacatgaagacgcacctggaccggccgctggtggtggagctgggccgcgacggcgcgcgggggcccgtgggaggcaaagcccgacctgaggctgcggaggcccccgagggcgtcgaccctccgcgcaggcaccaccggcaccgcgacaaggacaagacccccgcggcgggggaccaggaccgagcagaggccccgaaggcggagagcggggagcccggtgcccgggaggagcggccgcggccgcaccgcagccacagcaaggaggccgcggggcccccggaggcgcggagcgagcgcggccgaggcccaggccccgagggcggccggcggcaccaccggcgcggctccccggaggaggcggccgagcgggagccccgacgccaccgcgcgcaccggcaccaggatccgagcaaggagtgcgccggcgccaagggcgagcggcgcgcgcggcaccgcggcggcccccgagcggggccccgggaggcggagagcggggaggagccggcgcggcggcaccgggcccggcacaaggcgcagcctgctcacgaggctgtggagaaggagaccacggagaaggaggccacggagaaggaggctgagatagtggaagccgacaaggaaaaggagctccggaaccaccagccccgggagccacactgtgacctggagaccagtgggactgtgactgtgggtcccatgcacacactgcccagcacctgtctccagaaggtggaggaacagccagaggatgcagacaatcagcggaacgtcactcgcatgggcagtcagcccccagacccgaacactattgtacatatcccagtgatgctgacgggccctcttggggaagccacggtcgttcccagtggtaacgtggacctggaaagccaagcagaggggaagaaggaggtggaagcggatgacgtgatgaggagcggcccccggcctatcgtcccatacagctccatgttctgtttaagccccaccaacctgctccgccgcttctgccactacatcgtgaccatgaggtacttcgaggtggtcattctcgtggtcatcgccttgagcagcatcgccctggctgctgaggacccagtgcgcacagactcgcccaggaacaacgctctgaaatacctggattacattttcactggtgtctttacctttgagatggtgataaagatgatcgacttgggactgctgcttcaccctggagcctatttccgggacttgtggaacattctggacttcattgtggtcagtggcgccctggtggcgtttgctttctcaggatccaaagggaaagacatcaataccatcaagtctctgagagtccttcgtgtcctgcggcccctcaagaccatcaaacggctgcccaagctcaaggctgtgtttgactgtgtggtgaactccctgaagaatgtcctcaacatcttgattgtctacatgctcttcatgttcatatttgccgtcattgcggtgcagctcttcaaagggaagtttttctactgcacagatgaatccaaggagctggagagggactgcaggggtcagtatttggattatgagaaggaggaagtggaagctcagcccaggcagtggaagaaatacgactttcactacgacaatgtgctctgggctctgctgacgctgttcacagtgtccacgggagaaggctggcccatggtgctgaaacactccgtggatgccacctatgaggagcagggtccaagccctgggtaccgcatggagctgtccatcttctacgtggtctactttgtggtctttcccttcttcttcgtcaacatctttgtggctttgatcatcatcaccttccaggagcagggggacaaggtgatgtctgaatgcagcctggagaagaacgagagggcttgcattgacttcgccatcagcgccaaacccctgacacggtacatgccccaaaaccggcagtcgttccagtataagacgtggacatttgtggtctccccgccctttgaatacttcatcatggccatgatagccctcaacactgtggtgctgatgatgaagttctatgatgcaccctatgagtacgagctgatgctgaaatgcctgaacatcgtgttcacatccatgttctccatggaatgcgtgctgaagatcatcgcctttggggtgctgaactatttcagagatgcctggaatgtctttgactttgtcactgtgttgggaagtattactgatattttagtaacagagattgcggaaacgaacaatttcatcaacctcagcttcctccgcctctttcgagctgcgcggctgatcaagctgctccgccagggctacaccatccgcatcctgctgtggacctttgtccagtccttcaaggccctgccctacgtgtgtctgctcattgccatgctgttcttcatctacgccatcatcggcatgcaggtgtttgggaatattgccctggatgatgacaccagcatcaaccgccacaacaacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgtgggcgcatcagttacaatgacatgtttgagatgctgaaacacatgtccccgcctctggggctggggaagaaatgccctgctcgagttgcttacaagcgcctggttcgcatgaacatgcccatctccaacgaggacatgactgttcacttcacgtccacgctgatggccctcatccggacggcactggagatcaagctggccccagctgggacaaagcagcatcagtgtgacgcggagttgaggaaggagatttccgttgtgtgggccaatctgccccagaagactttggacttgctggtaccaccccataagcctgatgagatgacagtggggaaggtttatgcagctctgatgatattcgacttctacaagcagaacaaaaccaccagagaccagatgcagcaggctcctggaggcctctcccagatgggtcctgtgtccctgttccaccctctgaaggccaccctggagcagacacagccggctgtgctccgaggagcccgggttttccttcgacagaagagttccacctccctcagcaatggcggggccatacaaaaccaagagagtggcatcaaagagtctgtctcctggggcactcaaaggacccaggatgcaccccatgaggccaggccacccctggagcgtggccactccacagagatccctgtggggcggtcaggagcactggctgtggacgttcagatgcagagcataacccggaggggccctgatggggagccccagcctgggctggagagccagggtcgagcggcctccatgccccgccttgcggccgagactcagcccgtcacagatgccagccccatgaagcgctccatctccacgctggcccagcggccccgtgggactcatctttgcagcaccaccccggaccgcccaccccctagccaggcgtcgtcgcaccaccaccaccaccgctgccaccgccgcagggacaggaagcagaggtccctggagaaggggcccagcctgtctgccgatatggatggcgcaccaagcagtgctgtggggccggggctgcccccgggagaggggcctacaggctgccggcgggaacgagagcgccggcaggagcggggccggtcccaggagcggaggcagccctcatcctcctcctcggagaagcagcgcttctactcctgcgaccgctttgggggccgtgagcccccgaagcccaagccctccctcagcagccacccaacgtcgccaacagctggccaggagccgggaccccacccacagggcagtggttccgtgaatgggagccccttgctgtcaacatctggtgctagcacccccggccgcggtgggcggaggcagctcccccagacgcccctgactccccgccccagcatcacctacaagacggccaactcctcacccatccacttcgccggggctcagaccagcctccctgccttctccccaggccggctcagccgtgggctttccgaacacaacgccctgctgcagagagaccccctcagccagcccctggcccctggctctcgaattggctctgacccttacctggggcagcgtctggacagtgaggcctctgtccacgccctgcctgaggacactctcactttcgaggaggctgtggccaccaactcgggccgctcctccaggacttcctacgtgtcctccctgacctcccagtctcaccctctccgccgcgtgcccaacggttaccactgcaccctgggactcagctcgggtggccgagcacggcacagctaccaccaccctgaccaagaccactggtgctagctgcaccgtgaccgctcagacgcctgcatgcagcaggcgtgtgttccagtggatgagttttatcatccacacggggcagccggccctcgggggaggccttgcccaccttggtgaggctcctgtggcccctccctccccctcctcccctcttttactctagacgacgaataaagccctgttagaggatgcggctctctctgtccccttcctgtcctgccttcctgggtctcgtaccacacaccagaccctaaaccgcaggctgctgtgtgtggctgagaaggacccaggagtccaaatcccgtgtcctgggactcagcatccagcatgggtgcttggagccgttgtgaggagctctgcgtcctgtggggagcacccttcacgtggccgtgcggcacagagaagcagggcccacctgaaagtgcgccgagacctcgggacggaggggatggggagggggacacagtcgtggcttgtgcagcccgccagtgtcagcgaatgctcactcaggcaagctctgtcctccctggacaccgtcagccccacaggaaccgagctgggaagtgttcttgctgtggttgtgatttttaattgcaacacctctcattcttgtcacttctatatacgtgatgtagaaaaaatggaaaaccagaaaaatggggaaggaaatgttcacataactttaaaaaatcaaacctgtgaaagaaagatgtcagctttttgccacgtgtctttgtggcttatgcgaggagactccctgtgcagccctgtccggtccaggtggacgtagacggcccctggctctgctgctcttgaccaagtgcctgaccgccaggccctcacacccaggctcctgggcactgtggtgtgaggcgaggcctcgggatccatcaccgcaggatgctgtgaaaagtactcgcgatggcagccaggtagcaagcccttgccagtggagagcactggatgtcatggtggcaaacaaggcagccatttgctgtcctcctcccacgagtggaaggggtttccaaggaagccacagggcagctgaccacgtgcttgtgtgaggcattttcagtctgttctgcatatgattctcagggcacactctgtggtatgtgaaataggtttccttccacatacagcagaagagaggcaaaggctggtaggaaggaggaagacattggctgggggcttggatgtggggccgtcagggcaggagggaggaagccccagctggaatgaaactcagagcaagtgaccgagggaggacacggctcctgccactgaggccgggcacctgatgcccagcactgtcctggcgccagacacagggagcaggcagtcaagtgaggtctgacccccatggccacgctcaggagagaaagaccatgctcaggacactgtccaaggtgcacaagatgctgggaggtcccttgtttggtgaagaaagggagcatttagagcagttgatggtggtgtgtcctccgtgttctgaaattccagatgatctgtgttggattcttggcttctaccccatgattctcctcaaagaaattgtgtgtgatgtgtgtgtgtgtgtgtgtgtgtgtgtgtctgtgtcacaggagatgcagtgcctgtacaggtgtgttcagtgtgtggatgtcattaacccatagggctatgcaacaaaagacacatttaatagaagtaaaacacacaagaccgctgcctggtctcggggttcagcatgattgtgaccaaacctttttatagaatttccttacctgaaggcacaacactctgaaactttaaagataacagagtattttattccaatagaataaaccaggaatctcggactgtgcatgtgatcactgtgctcctgttgcaaagtagaaggatgtgtattttgacactgacgttttgtctcttgttccccagcccccagcccatgttatcttgggtgtcgaatgtgtccattccatgcagaaccacagccatttccccaggcagtgttgggtcgagaatccacttttctaaacccacacagcctagctggcttgtctagactcttctaggcattggaattgatgaaaactacagggagcggggaaaggagacattatgtcttgttttcctgactttgggttttgtttctcactgtgtcttctccggctatcatatatgtcccctgaatctcatagtgagctgccaaatttgaagtgcatcacccagttgtctgcatctggaaccagtcaagcagtggctgtagtttgaacaagttatgtgtgcatgtaacatatatacatatatacatatatacaagtatgtgcatgataatgtatatcttcgtactttttgatacaatgtattcatttgttaatttttaattatatttgatataaatcaaaggtttgttgcaaaactttatatttaagaagtgttaaaaaaaaaaaaaagtcccaaccatgcaacacaactgggacctacttaaaaagaaattctgtgattgactagtttgctgcctgagtcatatttatcagccaaactttggattctgctgttgtttctacaatgacattttgtatgaagcaaagtccttgaattaaaataaaaacttagcaaaaaatcaaaaacaaaacccca

SEQ ID NO: 113216 - DNA, 492 bp, Homo sapiens
  Payload ID: 2142
  Gene Symbol: CACNA1B
  Gene Name: calcium channel, voltage-dependent, N type, alpha 1B subunit
  ENST ID: ENST00000413253
  CDS Start-End: 1-492
caacttccggacgtttttgcaagccctgatgctgctgttcaggagcgccacgggggaggcctggcacgagatcatgctgtcctgcctgagcaaccaggcctgtgatgagcaggccaatgccaccgagtgtggaagtgactttgcctacttctacttcgtctccttcatcttcctgtgctcctttctgatgttgaacctctttgtggctgtgatcatggacaattttgagtacctcacgcgggactcttccatcctaggtcctcaccacttggatgagttcatccgggtctgggctgaatacgacccggctgcgtgttgccggattcattataaggatatgtacagtttgttgcgttgtattgcgccacccgttggcttagggaagaactgccctcgtaggttggcctacaagcgcctggttcgcatgaacatgcccatctccaacgaggacatgactgttcacttcacgtccacgctgatggccctcatccg

SEQ ID NO: 113217 - DNA, 8392 bp, Homo sapiens
  Payload ID: 2143
  Gene Symbol: CACNA1A
  Gene Name: calcium channel, voltage-dependent, P/Q type, alpha 1A subunit
  Uniprot ID: O00555
  ENST ID: ENST00000360228
  CDS Start-End: 1-7521
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatgctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 113218 - DNA, 659 bp, Homo sapiens
  Payload ID: 2143
  Gene Symbol: CACNA1A
  Gene Name: calcium channel, voltage-dependent, P/Q type, alpha 1A subunit
  ENST ID: ENST00000574974
  CDS Start-End: 351-659
cagatagctcggacccctgggtgctgacgagatgggaccctcgggacccctggaggactcgcagtgctgaccactagccgcgtcgcctgagccccagcgctgatgcgatacagtttccccctcactgtgctggagggagaagaccctgggatttctgagcgaggcccgtggatgttgaagtcttcctgggtccccgactccatgctctcgcgccccagttactatgacgccctgcacaaccgcagctcggggcacgcccagcgccctgcaggacactcggcctccccggctcagcatctgcttcgagggcccccctctgaggcggcggggcggcgtggtggatcaccgagatgtcatcttggcccaccaggcccacaaaatccacagcaccccccaggccaggaggaaagaatgggaccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttggg

SEQ ID NO: 113219 - DNA, 7810 bp, Homo sapiens
  Payload ID: 2143
  Gene Symbol: CACNA1A
  Gene Name: calcium channel, voltage-dependent, P/Q type, alpha 1A subunit
  Uniprot ID: O00555
  ENST ID: ENST00000573710
  CDS Start-End: 280-7065
cgcaccctcctcccgcccctccttctccggggtcagccaggaagatgtcccgagctgctatccccggctcggcccgggcagccgccttctgagcccccgacccgaggcgccgagccgccgccgcccgatgggctgggccgtggagcgtctccgcagtcgtagctccagccgccgcgctcccagccccggcagcctcagcatcagcggcggcggcggcggcggcggcgtcttccgcatcgttcgccgcagcgtaacccggagccctttgctctttgcagaatggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggcctccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgagg

SEQ ID NO: 113220 - DNA, 819 bp, Homo sapiens
  Payload ID: 2143
  Gene Symbol: CACNA1A
  Gene Name: calcium channel, voltage-dependent, P/Q type, alpha 1A subunit
  ENST ID: ENST00000573891
  CDS Start-End: 1-238
gaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttggggcctggtcccgtgctactccacccagccccagaagctgagaagccatccctgagaggggggaaaagggccccaaatgcatcttctccgactcagcgggcagcgaggactcaccctgcagccgaacagtcccagctccctcccgtcctccccattcccgctcgccaaggggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctg

SEQ ID NO: 113221 - DNA, 744 bp, Homo sapiens
  Payload ID: 2143
  Gene Symbol: CACNA1A
  Gene Name: calcium channel, voltage-dependent, P/Q type, alpha 1A subunit
  ENST ID: ENST00000592864
  CDS Start-End: 149-256
tgctctcgcgccccagttactatgacgccctgcacaaccgcagctcggggcacgcccagcgccctgcaggacactcggcctccccggctcagcatctgcttcgagggcccccctctgaggcggcggggcggcgtggtggatcaccgagatgtcatcttggcccaccaggcccacaaaatccacagcaccccccaggccaggaggaaagaatgggagaagctaccagaggatgtgcttcacccaaacaagggagtaaaccaagaagagggaaacagagaacactggacttaagaaatccaacaatgagaagcaaagggaatctcctggatgatgataaagagagagcccaggatgaaagctgtatgccagggaaagtcctgattagaccatgtgacaagtcttcaggaaagactgcttctggatgataaaatgaactgaatacctgttaagagacttggggggtcaaatttgcaataagtaccaaacaaagaagattaaaaaatgataagtcccaagggaaacaatatgttgtaaagaaaaagtagctatagtttgttcatgacataactgtaacttgccttgtacatgataatataaacaccgaatcttcctcactttgtgaaagaacaatattgggcaaatgcgcaggttttggaaagttccatgtgtagggggatggagggagaaattagcaaaatcctccttttctatagctaatacctataaagtgctacaacacccaga

SEQ ID NO: 113222 - DNA, 3555 bp, Homo sapiens
  Payload ID: 2143
  Gene Symbol: CACNA1A
  Gene Name: calcium channel, voltage-dependent, P/Q type, alpha 1A subunit
  ENST ID: ENST00000585802
  CDS Start-End: 1-3543
ctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgagg

SEQ ID NO: 113223 - DNA, 3765 bp, Homo sapiens
  Payload ID: 2143
  Gene Symbol: CACNA1A
  Gene Name: calcium channel, voltage-dependent, P/Q type, alpha 1A subunit
  ENST ID: ENST00000587525
  CDS Start-End: 1-2946
caggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttgcggtcggattcattataaggatatgtacagtttattacgagtaatatctccccctctcggcttaggcaagaaatgtcctcatagggttgcttgcaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaa

SEQ ID NO: 113224 - DNA, 8410 bp, Homo sapiens
  Payload ID: 2143
  Gene Symbol: CACNA1A
  Gene Name: calcium channel, voltage-dependent, P/Q type, alpha 1A subunit
  ENST ID: ENST00000614285
  CDS Start-End: 1-7539
atggcccgcttcggagacgagatgccggcccgctacgggggaggaggctccggggcagccgccggggtggtcgtgggcagcggaggcgggcgaggagccgggggcagccggcagggcgggcagcccggggcgcaaaggatgtacaagcagtcaatggcgcagagagcgcggaccatggcactctacaaccccatccccgtccgacagaactgcctcacggttaaccggtctctcttcctcttcagcgaagacaacgtggtgagaaaatacgccaaaaagatcaccgaatggccaccctttgaatatatgattttagccaccatcatagcgaattgcatcgtcctcgcactggagcagcatctgcctgatgatgacaagaccccgatgtctgaacggctggatgacacagaaccatacttcattggaattttttgtttcgaggctggaattaaaatcattgcccttgggtttgccttccacaaaggctcctacttgaggaatggctggaatgtcatggactttgtggtggtgctaacgggcatcttggcgacagttgggacggagtttgacctacggacgctgagggcagttcgagtgctgcggccgctcaagctggtgtctggaatcccaagtttacaagtcgtcctgaagtcgatcatgaaggcgatgatccctttgctgcagatcggcctcctcctattttttgcaatccttatttttgcaatcatagggttagaattttatatgggaaaatttcataccacctgctttgaagaggggacagatgacattcagggtgagtctccggctccatgtgggacagaagagcccgcccgcacctgccccaatgggaccaaatgtcagccctactgggaagggcccaacaacgggatcactcagttcgacaacatcctgtttgcagtgctgactgttttccagtgcataaccatggaagggtggactgatctcctctacaatagcaacgatgcctcagggaacacttggaactggttgtacttcatccccctcatcatcatcggctccttttttatgctgaaccttgtgctgggtgtgctgtcaggggagtttgccaaagaaagggaacgggtggagaaccggcgggcttttctgaagctgaggcggcaacaacagattgaacgtgagctcaatgggtacatggagtggatctcaaaagcagaagaggtgatcctcgccgaggatgaaactgacggggagcagaggcatccctttgatggagctctgcggagaaccaccataaagaaaagcaagacagatttgctcaaccccgaagaggctgaggatcagctggctgatatagcctctgtgggttctcccttcgcccgagccagcattaaaagtgccaagctggagaactcgaccttttttcacaaaaaggagaggaggatgcgtttctacatccgccgcatggtcaaaactcaggccttctactggactgtactcagtttggtagctctcaacacgctgtgtgttgctattgttcactacaaccagcccgagtggctctccgacttcctttactatgcagaattcattttcttaggactctttatgtccgaaatgtttataaaaatgtacgggcttgggacgcggccttacttccactcttccttcaactgctttgactgtggggttatcattgggagcatcttcgaggtcatctgggctgtcataaaacctggcacatcctttggaatcagcgtgttacgagccctcaggttattgcgtattttcaaagtcacaaagtactgggcatctctcagaaacctggtcgtctctctcctcaactccatgaagtccatcatcagcctgttgtttctccttttcctgttcattgtcgtcttcgcccttttgggaatgcaactcttcggcggccagtttaatttcgatgaagggactcctcccaccaacttcgatacttttccagcagcaataatgacggtgtttcagatcctgacgggcgaagactggaacgaggtcatgtacgacgggatcaagtctcaggggggcgtgcagggcggcatggtgttctccatctatttcattgtactgacgctctttgggaactacaccctcctgaatgtgttcttggccatcgctgtggacaatctggccaacgcccaggagctcaccaaggtggaggcggacgagcaagaggaagaagaagcagcgaaccagaaacttgccctacagaaagccaaggaggtggcagaagtgagtcctctgtccgcggccaacatgtctatagctgtgaaagagcaacagaagaatcaaaagccagccaagtccgtgtgggagcagcggaccagtgagatgcgaaagcagaacttgctggccagccgggaggccctgtataacgaaatggacccggacgagcgctggaaggctgcctacacgcggcacctgcggccagacatgaagacgcacttggaccggccgctggtggtggacccgcaggagaaccgcaacaacaacaccaacaagagccgggcggccgagcccaccgtggaccagcgcctcggccagcagcgcgccgaggacttcctcaggaaacaggcccgctaccacgatcgggcccgggaccccagcggctcggcgggcctggacgcacggaggccctgggcgggaagccaggaggccgagctgagccgggagggaccctacggccgcgagtcggaccaccacgcccgggagggcagcctggagcaacccgggttctgggagggcgaggccgagcgaggcaaggccggggacccccaccggaggcacgtgcaccggcaggggggcagcagggagagccgcagcgggtccccgcgcacgggcgcggacggggagcatcgacgtcatcgcgcgcaccgcaggcccggggaggagggtccggaggacaaggcggagcggagggcgcggcaccgcgagggcagccggccggcccggggcggcgagggcgagggcgagggccccgacgggggcgagcgcaggagaaggcaccggcatggcgctccagccacgtacgagggggacgcgcggagggaggacaaggagcggaggcatcggaggaggaaagagaaccagggctccggggtccctgtgtcgggccccaacctgtcaaccacccggccaatccagcaggacctgggccgccaagacccacccctggcagaggatattgacaacatgaagaacaacaagctggccaccgcggagtcggccgctccccacggcagccttggccacgccggcctgccccagagcccagccaagatgggaaacagcaccgaccccggccccatgctggccatccctgccatggccaccaacccccagaacgccgccagccgccggacgcccaacaacccggggaacccatccaatcccggcccccccaagacccccgagaatagccttatcgtcaccaaccccagcggcacccagaccaattcagctaagactgccaggaaacccgaccacaccacagtggacatccccccagcctgcccaccccccctcaaccacaccgtcgtacaagtgaacaaaaacgccaacccagacccactgccaaaaaaagaggaagagaagaaggaggaggaggaagacgaccgtggggaagacggccctaagccaatgcctccctatagctccatgttcatcctgtccacgaccaacccccttcgccgcctgtgccattacatcctgaacctgcgctactttgagatgtgcatcctcatggtcattgccatgagcagcatcgccctggccgccgaggaccctgtgcagcccaacgcacctcggaacaacgtgctgcgatactttgactacgtttttacaggcgtctttacctttgagatggtgatcaagatgattgacctggggctcgtcctgcatcagggtgcctacttccgtgacctctggaatattctcgacttcatagtggtcagtggggccctggtagcctttgccttcactggcaatagcaaaggaaaagacatcaacacgattaaatccctccgagtcctccgggtgctacgacctcttaaaaccatcaagcggctgccaaagctcaaggctgtgtttgactgtgtggtgaactcacttaaaaacgtcttcaacatcctcatcgtctacatgctattcatgttcatcttcgccgtggtggctgtgcagctcttcaaggggaaattcttccactgcactgacgagtccaaagagtttgagaaagattgtcgaggcaaatacctcctctacgagaagaatgaggtgaaggcgcgagaccgggagtggaagaagtatgaattccattacgacaatgtgctgtgggctctgctgaccctcttcaccgtgtccacgggagaaggctggccacaggtcctcaagcattcggtggacgccacctttgagaaccagggccccagccccgggtaccgcatggagatgtccattttctacgtcgtctactttgtggtgttccccttcttctttgtcaatatctttgtggccttgatcatcatcaccttccaggagcaaggggacaagatgatggaggaatacagcctggagaaaaatgagagggcctgcattgatttcgccatcagcgccaagccgctgacccgacacatgccgcagaacaagcagagcttccagtaccgcatgtggcagttcgtggtgtctccgcctttcgagtacacgatcatggccatgatcgccctcaacaccatcgtgcttatgatgaagttctatggggcttctgttgcttatgaaaatgccctgcgggtgttcaacatcgtcttcacctccctcttctctctggaatgtgtgctgaaagtcatggcttttgggattctgaattatttccgcgatgcctggaacatcttcgactttgtgactgttctgggcagcatcaccgatatcctcgtgactgagtttgggaatccgaataacttcatcaacctgagctttctccgcctcttccgagctgcccggctcatcaaacttctccgtcagggttacaccatccgcattcttctctggacctttgtgcagtccttcaaggccctgccttatgtctgtctgctgatcgccatgctcttcttcatctatgccatcattgggatgcaggtgtttggtaacattggcatcgacgtggaggacgaggacagtgatgaagatgagttccaaatcactgagcacaataacttccggaccttcttccaggccctcatgcttctcttccggagtgccaccggggaagcttggcacaacatcatgctttcctgcctcagcgggaaaccgtgtgataagaactctggcatcctgactcgagagtgtggcaatgaatttgcttatttttactttgtttccttcatcttcctctgctcgtttctgatgctgaatctctttgtcgccgtcatcatggacaactttgagtacctcacccgagactcctccatcctgggcccccaccacctggatgagtacgtgcgtgtctgggccgagtatgaccccgcagcttggggccgcatgccttacctggacatgtatcagatgctgagacacatgtctccgcccctgggtctggggaagaagtgtccggccagagtggcttacaagcggcttctgcggatggacctgcccgtcgcagatgacaacaccgtccacttcaattccaccctcatggctctgatccgcacagccctggacatcaagattgccaagggaggagccgacaaacagcagatggacgctgagctgcggaaggagatgatggcgatttggcccaatctgtcccagaagacgctagacctgctggtcacacctcacaagtccacggacctcaccgtggggaagatctacgcagccatgatgatcatggagtactaccggcagagcaaggccaagaagctgcaggccatgcgcgaggagcaggaccggacacccctcatgttccagcgcatggagcccccgtccccaacgcaggaagggggacctggccagaacgccctcccctccacccagctggacccaggaggagccctgatggctcacgaaagcggcctcaaggagagcccgtcctgggtgacccagcgtgcccaggagatgttccagaagacgggcacatggagtccggaacaaggcccccctaccgacatgcccaacagccagcctaactctcagtccgtggagatgcgagagatgggcagagatggctactccgacagcgagcactacctccccatggaaggccagggccgggctgcctccatgccccgcctccctgcagagaaccagaggagaaggggccggccacgtgggaataacctcagtaccatctcagacaccagccccatgaagcgttcagcctccgtgctgggccccaaggcccgacgcctggacgattactcgctggagcgggtcccgcccgaggagaaccagcggcaccaccagcggcgccgcgaccgcagccaccgcgcctctgagcgctccctgggccgctacaccgatgtggacacaggcttggggacagacctgagcatgaccacccaatccggggacctgccgtcgaaggagcgggaccaggagcggggccggcccaaggatcggaagcatcgacagcaccaccaccaccaccaccaccaccaccatcccccgccccccgacaaggaccgctatgcccaggaacggccggaccacggccgggcacgggctcgggaccagcgctggtcccgctcgcccagcgagggccgagagcacatggcgcaccggcagggcagtagttccgtaagtggaagcccagccccctcaacatctggtaccagcactccgcggcggggccgccgccagctcccccagaccccctccaccccccggccacacgtgtcctattcccctgtgatccgtaaggccggcggctcggggcccccgcagcagcagcagcagcagcagcagcagcagcagcagcaggcggtggccaggccgggccgggcggccaccagcggccctcggaggtacccaggccccacggccgagcctctggccggagatcggccgcccacggggggccacagcagcggccgctcgcccaggatggagaggcgggtcccaggcccggcccggagcgagtcccccagggcctgtcgacacggcggggcccggtggccggcatctggcccgcacgtgtccgaggggcccccgggtccccggcaccatggctactaccggggctccgactacgacgaggccgatggcccgggcagcgggggcggcgaggaggccatggccggggcctacgacgcgccaccccccgtacgacacgcgtcctcgggcgccaccgggcgctcgcccaggactccccgggcctcgggcccggcctgcgcctcgccttctcggcacggccggcgactccccaacggctactacccggcgcacggactggccaggccccgcgggccgggctccaggaagggcctgcacgaaccctacagcgagagtgacgatgattggtgctaagcccgggcgaggtggcgcccgcccggccccccacgcaccccacgcacacaccccacccgaggagccgcgcagaggccgcgggggcccagcacagagggcccgggagagggccagccgggagaccccagactctggagaggccagggctgggccacaagggtgtcccgcagagaccctcggccaaaagagaccctcctgggcagccacggcgccccccaaccagccccgatccccccacccacgacaggggctctcgggtgggaggcagggagcagacaaaccacacagccaagggatttgaattaactcagccatttttggagaactttggggaacatgaaaaaaaaaaaaaaaaaaaaaaaaaaaaacatttttaaaagaaaaaacggggagaaaaaaatagcttctattgatgagttttatcatctcaattgaatctttcctttccctgatgaagacagctggtggccgagtgcggcaaagaagccagaaggaaccagaatcccagtgccctacacccaccaccagacacactcacacccacacacgttctcagacacacacaagagtgcttgccggttataccaaaccctactattactgcctgcagaaatcaatttaaaaaaataataataacaataaacaattttaaaaaggacaaaaaaattaatgattgagaaaagaggcatttttttctgacatttggtcctgcttgaaacaacaaaagaagaagaaaaacccaccatcaccaccgattcctttgcttcttttttccttttttcctaccttgtttgaaaaccgtgggcttgggactgtgaattattgcatgacattcaaaaagaaaaaaaaaataaaaaaaagttgaatcaaa

SEQ ID NO: 113225 - DNA, 7064 bp, Homo sapiens
  Payload ID: 2144
  Gene Symbol: CACNA1E
  Gene Name: calcium channel, voltage-dependent, R type, alpha 1E subunit
  ENST ID: ENST00000357570
  CDS Start-End: 1-6939
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggctggcccggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcggactcttttcgaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcatta

SEQ ID NO: 113226 - DNA, 14700 bp, Homo sapiens
  Payload ID: 2144
  Gene Symbol: CACNA1E
  Gene Name: calcium channel, voltage-dependent, R type, alpha 1E subunit
  Uniprot ID: Q15878
  ENST ID: ENST00000358338
  CDS Start-End: 1-6756
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccaccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgt

SEQ ID NO: 113227 - DNA, 6970 bp, Homo sapiens
  Payload ID: 2144
  Gene Symbol: CACNA1E
  Gene Name: calcium channel, voltage-dependent, R type, alpha 1E subunit
  ENST ID: ENST00000360108
  CDS Start-End: 8-6892
cctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggccc

SEQ ID NO: 113228 - DNA, 14757 bp, Homo sapiens
  Payload ID: 2144
  Gene Symbol: CACNA1E
  Gene Name: calcium channel, voltage-dependent, R type, alpha 1E subunit
  Uniprot ID: Q15878
  ENST ID: ENST00000367567
  CDS Start-End: 1-6813
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccaccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgt

SEQ ID NO: 113229 - DNA, 9724 bp, Homo sapiens
  Payload ID: 2144
  Gene Symbol: CACNA1E
  Gene Name: calcium channel, voltage-dependent, R type, alpha 1E subunit
  Uniprot ID: Q15878
  ENST ID: ENST00000367570
  CDS Start-End: 166-6978
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaa

SEQ ID NO: 113230 - DNA, 7067 bp, Homo sapiens
  Payload ID: 2144
  Gene Symbol: CACNA1E
  Gene Name: calcium channel, voltage-dependent, R type, alpha 1E subunit
  Uniprot ID: Q15878
  ENST ID: ENST00000367573
  CDS Start-End: 1-6942
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcatta

SEQ ID NO: 113231 - DNA, 1795 bp, Homo sapiens
  Payload ID: 2144
  Gene Symbol: CACNA1E
  Gene Name: calcium channel, voltage-dependent, R type, alpha 1E subunit
  ENST ID: ENST00000524607
  CDS Start-End: 481-1795
actccttgtctctgccctctccctcccacagagcaatgttctgtgatggtgcccgagatgcgtggactgagcccagaccgcaggctgcccgagcccgccccctgcccggctgcggggagccctgagcccaggtccgcgggccgccgccaacgccacgtcctggccctgccggaagaagaggcatggcggccccagcagtgcgctctgctcgaggccgacgcctcggacgaggtgggcatgctgccggcttccccgcgcgccgcctctggcttcgacaacttcttccaggtgcaggagggcgagggccagggctgggagggcgccatggcactggaggcgggctccagccctttcctgccggtgagccccgaggtcatgaagcggcggcgcgggggcctcatcgagcagcgcgacatcatcaaggcccacgaggcgcacaagatgcagagcaccccgcaggcccggcgcaaggaatgggagatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgg

SEQ ID NO: 113232 - DNA, 16171 bp, Homo sapiens
  Payload ID: 2144
  Gene Symbol: CACNA1E
  Gene Name: calcium channel, voltage-dependent, R type, alpha 1E subunit
  Uniprot ID: Q15878
  ENST ID: ENST00000621791
  CDS Start-End: 166-6921
gctgctgctgcctctccgaagagctcgcggagctccccagaggcggtggtccccgtgcttgtctggatgcggctctgagtctccgtgtgtctttctgcttgttgctgtgtgcgggtgttcggccgcgatcacctttgtgtgtcttctgtctgtttaaacctcaggatggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccgccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgagagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgtaaagaatgcatcggcctgatttccctcacttgatgtgtttctttgctgctaccagaaagggaaatcatgggagtgaagcctgccaggaccctcagggtaagctggcagcaggctctgcagctgcacttagttggggtctgctcagaccagtcaggaggaattcaggaggctttcaaagtcccaaggacatcctggctctgaaaggttttcttttgttaaaaaatgcactttgtgctgtgtgtggtagctcgtatgtgttaccccagctattcaggaagctagggcagaaggattgcttgaggctaggaattcaagactggcctggatgacagagtgaaaccctcatctcttaaaaaaaaaaaaaaggaataaaaatgttctctgccttggataacatttttttttaaagattccatacaaactcattccctgaaagagaaaaacagattttctaatcaggacattgtcctgatctgcaagcgaggagtttaacaaggtaggcagagaacttccttatggaacaacagggctctgtgaccagaaaaactatgaccagcctcctctgaaaaaaggtggggggattatagggcaccagctcagccgccaagttcaggaagcagctgattcccaagactcttaggagatactgtccattcttcctcctgtccacatcactccccatttaactgcaattgctcccttgccacagggaaagcagcaagccccaggcccaggcctccatttgatttgccactccgagaactgtctgcttcattctgcttgaggagatatcttcacctaatcctagtgttaattattttaatctgagcaacgcttttatcaattagatagaaaccagcattccaaaataagtcccctaagtttgtagtttgagccaagatattttcttgagccctaagatatatgactttattagctaggatttttcttatgattaaaaacatccaaaaatgtgatatgtggtcatctctcagggaggtctaggtccttgcaggctggattttagaaatttctaagattctctacaacttttaaattttatgttatttttcaatcataatttctttcctgtggcttctatcaccattggagttagaatctgacaacctttaacttcacacttttatgagataataagttggtttcttgggcaaaggttggtttgtaagccatttacatggattgatgatttctgttcttgttttcttctaacctagaactcaggtccacagttttccacaggctaatggcactatgaaacagatataaagaaaaatagacactg

SEQ ID NO: 113233 - DNA, 14886 bp, Homo sapiens
  Payload ID: 2144
  Gene Symbol: CACNA1E
  Gene Name: calcium channel, voltage-dependent, R type, alpha 1E subunit
  Uniprot ID: Q15878
  ENST ID: ENST00000621551
  CDS Start-End: 1-6942
atggctcgcttcggggaggcggtggtcgccaggccagggtccggcgatggagactcggaccagagcaggaaccggcaaggaacccccgtgccggcctcggggcaggcggccgcctacaagcagacgaaagcacagagggcgcggactatggctttgtacaaccccattcccgtccggcagaactgtttcaccgtcaacagatccctgttcatcttcggagaagataacattgtcaggaaatatgccaagaagctcatcgattggccaccatttgagtacatgatcctggccaccatcattgccaactgcatcgtcctggccctggagcagcatcttcctgaggatgacaagacccccatgtcccgaagactggagaagacagaaccttatttcattgggatcttttgctttgaagctgggatcaaaattgtggccctggggttcatcttccataagggctcttacctccgcaatggctggaatgtcatggacttcatcgtggtcctcagtggcatcctggccactgcaggaacccacttcaatactcacgtggacctgaggaccctccgggctgtgcgtgtcctgcggcctttgaagctcgtgtcagggatacctagcctgcagattgtgttgaagtccatcatgaaggccatggtacctcttctgcagattggccttctgctcttctttgccatcctgatgtttgctatcattggtttggagttctacagtggcaagttacatcgagcatgcttcatgaacaattcaggtattctagaaggatttgacccccctcacccatgtggtgtgcagggctgcccagctggttatgaatgcaaggactggatcggccccaatgatgggatcacccagtttgataacatcctttttgctgtgctgactgtcttccagtgcatcaccatggaagggtggaccactgtgctgtacaataccaatgatgccttaggagccacctggaattggctgtacttcatccccctcatcatcattggatccttctttgttctcaacctagtcctgggagtgctttccggggaatttgccaaagagagagagagagtggagaaccgaagggctttcatgaagctgcggcgccagcagcagattgagcgtgagctgaatggctaccgtgcctggatagacaaagcagaggaagtcatgctcgctgaagaaaataaaaatgctggaacatccgccttagaagtgcttcgaagggcaaccatcaagaggagccggacagaggccatgactcgagactccagtgatgagcactgtgttgatatctcctctgtgggcacacctctggcccgagccagtatcaaaagtgcaaaggtagacggggtctcttatttccggcacaaggaaaggcttctgcgcatctccattcgccacatggttaaatcccaggtgttttactggattgtgctgagccttgtggcactcaacactgcctgtgtggccattgtccatcacaaccagccccagtggctcacccacctcctctactatgcagaatttctgtttctgggactcttcctcttggagatgtccctgaagatgtatggcatggggcctcgcctttattttcactcttcattcaactgctttgattttggggtcacagtgggcagtatctttgaagtggtctgggcaatcttcagacctggtacgtcttttggaatcagtgtcttgcgagccctccggcttctaagaatatttaaaataaccaagtattgggcttccctacggaatttggtggtctccttgatgagctcaatgaagtctatcatcagtttgcttttcctcctcttcctcttcatcgttgtctttgctctcctaggaatgcagttatttggaggcaggtttaactttaatgatgggactccttcggcaaattttgataccttccctgcagccatcatgactgtgttccagatcctgacgggtgaggactggaatgaggtgatgtacaatgggatccgctcccagggtggggtcagctcaggcatgtggtctgccatctacttcattgtgctcaccttgtttggcaactacacgctactgaatgtgttcttggctatcgctgtggataatctcgccaacgcccaggaactgaccaaggatgaacaggaggaagaagaggccttcaaccagaaacatgcactgcagaaggccaaggaggtcagcccgatgtctgcacccaacatgccttcgatcgaaagagacagaaggagaagacaccacatgtcgatgtgggagccacgcagcagccacctgagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctggacaaccagaggacccctttgtccctgggccagcgggagccaccatggctggccaggccctgtcatggaaactgtgacccgactcagcaggaggcagggggaggagaggctgtggtgacctttgaggaccgggccaggcacaggcagagccaacggcgcagccggcatcgccgcgtcaggacagaaggcaaggagtcctcttcagcctcccggagcaggtctgccagccaggaacgcagtctggatgaagccatgcccactgaaggggagaaggaccatgagctcaggggcaaccatggtgccaaggagccaacgatccaagaagagagagcccaggatttaaggaggaccaacagtctgatggtgtccagaggctccgggctggcaggaggccttgatgaggctgacacccccctagtcctgccccatcctgagctggaagtggggaagcacgtggtgctgacggagcaggagccagaaggcagcagtgagcaggccctgctggggaatgtgcagctagacatgggccgggtcatcagccagagcgagcctgacctctcctgcatcacggccaacacggacaaggccaccaccgagagcaccagcgtcaccgtcgccatccccgacgtggaccccttggtggactcaaccgtggtgcacattagcaacaagacggatggggaagccagtcccttgaaggaggcagagatcagagaggatgaggaggaggtggagaagaagaagcagaagaaggagaagcgtgagacaggcaaagccatggtgccccacagctcaatgttcatcttcagcaccaccaacccgatccggagggcctgccactacatcgtgaacctgcgctactttgagatgtgcatcctcctggtgattgcagccagcagcatcgccctggcggcagaggaccccgtcctgaccaactcggagcgcaacaaagtcctgaggtattttgactatgtgttcacgggcgtgttcacctttgagatggttataaagatgatagaccaaggcttgatcctgcaggatgggtcctacttccgagacttgtggaacatcctggactttgtggtggtcgttggcgcattggtggcctttgctctggcgaacgctttgggaaccaacaaaggacgggacatcaagaccatcaagtctctgcgggtgctccgagttctaaggccactgaaaaccatcaagcgcttgcccaagctcaaggccgtcttcgactgcgtagtgacctccttgaagaatgtcttcaacatactcattgtgtacaagctcttcatgttcatctttgctgtcatcgcagttcagctcttcaagggaaagttcttttattgcacggacagttccaaggacacagagaaggagtgcataggcaactatgtagatcatgagaaaaacaagatggaggtgaagggccgggaatggaagcgccatgaattccactacgacaacattatctgggccctgctgaccctcttcaccgtctccacaggggaaggatggcctcaagttctgcagcactctgtagatgtgacagaggaagaccgaggcccaagccgcagcaaccgcatggagatgtctatcttttatgtagtctactttgtggtcttccccttcttctttgtcaatatctttgtggctctcatcatcatcaccttccaggagcaaggggataagatgatggaggagtgcagcctggagaagaatgagagggcgtgcatcgacttcgccatcagcgccaaacctctcacccgctacatgccgcagaacagacacaccttccagtaccgcgtgtggcactttgtggtgtctccgtcctttgagtacaccattatggccatgatcgccttgaatactgttgtgctgatgatgaagtattattctgctccctgtacctatgagctggccctgaagtacctgaatatcgccttcaccatggtgttttccctggaatgtgtcctgaaggtcatcgcttttggctttttgaactatttccgagacacctggaatatctttgacttcatcaccgtgattggcagtatcacagaaattatcctgacagacagcaagctggtgaacaccagtggcttcaatatgagctttctgaagctcttccgagctgcccgcctcataaagctcctgcgtcagggctataccatacgcattttgctgtggacctttgtgcagtcctttaaggccctcccttatgtctgccttttaattgccatgcttttcttcatttatgccatcattgggatgcaggtatttggaaacataaaattagacgaggagagtcacatcaaccggcacaacaacttccggagtttctttgggtccctaatgctactcttcaggagtgccacaggtgaggcctggcaggagattatgctgtcatgccttggggagaagggctgtgagcctgacaccaccgcaccatcagggcagaacgagaacgaacgctgcggcaccgatctggcctacgtgtactttgtctccttcatcttcttctgctccttcttgatgctcaacctgtttgtggccgtcatcatggacaactttgagtacctgactcgggactcctccatcctggggcctcaccacttggacgagtttgtccgcgtctgggcagaatatgaccgagcagcatgtggccgcatccattacactgagatgtatgaaatgctgactctcatgtcacctccgctaggcctcggcaagagatgtccctccaaagtggcatataagaggttggtcctgatgaacatgccagtagctgaggacatgacggtccacttcacctccacacttatggctctgatccggacagctctggacattaaaattgccaaaggtggtgcagacaggcagcagctagactcagagctacaaaaggagaccctagccatctggcctcacctatcccagaagatgctggatctgcttgtgcccatgcccaaagcctctgacctgactgtgggcaaaatctatgcagcaatgatgatcatggactactataagcagagtaaggtgaagaagcagaggcagcagctggaggaacagaaaaatgcccccatgttccagcgcatggagccttcatctctgcctcaggagatcattgctaatgccaaagccctgccttacctccagcaggaccccgtttcaggcctgagtggccggagtggatacccttcgatgagtccactctctccccaggatatattccagttggcttgtatggaccccgccgatgacggacagttccaagaacggcagtctctggagccagaggttagtgaattaaaaagcgtgcagccctctaaccatggcatctaccttccttcggacacccaggagcatgcgggatctgggagggcatcttctatgccacgtctgactgtggatccccaggtggtgacagaccctagctccatgagacgttcattttccactattcgggataagcgttcaaattcctcgtggttggaggaattctccatggagcgaagcagtgaaaatacctacaagtcccgtcgccggagttaccactcctccttgcggctgtcagcccaccgcctgaactctgattcaggccacaagtctgacactcaccgctcagggggcagggagcggggacgatcaaaagagcgaaagcatcttctctctcctgatgtctcccgctgcaattcagaagagcgagggacccaggctgactgggagtccccagagcgccgtcaatccaggtcacccagtgagggcaggtcacagacgcccaacagacagggcacaggttccctaagtgagagctccatcccctctgtctctgacaccagcaccccaagaagaagtcgtcggcagctcccacccgtcccgccaaagccccggcccctcctttcctacagctccctgattcgacacgcgggcagcatctctccacctgctgatggaagcgaggagggctccccgctgacctcccaagctctggagagcaacaatgcttgcctgaccgagtcttccaactctccgcacccccagcagagccaacatgcctccccacagcgctacatctccgagccctacttggccctgcacgaagactcccacgcctcagactgtggtgaggaggagacgctcactttcgaagcagccgtggctactagcctgggccgttccaacaccatcggctcagccccacccctgcggcatagctggcagatgcccaacgggcactatcggcggcggaggcgcggggggcctgggccaggcatgatgtgtggggctgtcaacaacctgctaagtgacacggaagaagatgacaaatgctagaggctgctcccccctccgatgcatgctcttctctcacatggagaaaaccaagacagaattgggaagccagtgcggcccgggggggaggaagagggaaaaggaagatggaaggacaccatgcattatcagagaagaggaagtaaaggacaatcagaacaccagtcaaacccaccaaattgctttattcccctttgcaagatgggcactgccatagttctgcctctttgctggggaaagaaaccaggaacgtggagggttattactgcgggagaagggacacgaggatggctttgcttccccttgccccttcccacttttctaaaagctgtggagggatctagctggcctatgtctacactcagtgccctgagaagcctggaagactttctggctcttaactggggagtagtggagaccataggagaggactctcctccctcaccagctcttacgcctcagccagcaccactgccaccagggcaactgcagcagcatctcatgcataaccctgtggcttgcttcccccagggcagcacaggctaagtcaggaacatcggatgccagggagggaggagaaagccgaagcgaaaggggtcagggtgctgaggcaacagcagcaagggctggtctggacaagaaaagccatagcccggcagcccctaccatgagggagacagagaaacagaactggtggtgctggggggtatagccccccatccttgaggcctgtcacccacacagtaggtgctgagagttaggacaggtcaggaagtcccccagggtccacaaaggtgcctgaggctctggtaagggtgaagataaaagtatttaacaaccgctatggcatcaatgtaagtggagtttggtcctagtgccggagcccatgctattccaggcattggctctttagatgccagtcatgggggaaccctgagggtgtgggtagagtagcaggggccacctaagagattaaaaacagtctgttttccaaccagtgtggaagcaattaaatatgcgtaacagtgctacggccacaccagcacctcctggctgaaggtcagcccacactctggtccatgaggcagcaaggccagtgctgtgccaagcccggtaaggccaagtgccgaggcccagccttccctgccactcctctgagagggcagaacacacatatccaagtaggctacccaccactgggtagggatttctgtaaagatgggaaaggctgatagattgaaataagcttctgtgaaagtctggatttactgaggacctcccctgaggagggaccgttgggaccgcagattctgcagctggtgtggggttcaggtcagtttgtcaggatgctttaaggtgattagtaaatatacctcagcttagacttgggctgctccttctagcaaagcaggctccagtggggcctcatcatacaggatgacaagactggggccctgttcaccttgaacatgcccctgggccaagatggggcttcacccctccccagagtaagagctggggctgacagtcccaccctgtcattcctaatagcccaaacgcagaagcactgagcaagagagccctttcttgccaagccagtgctcttttggtatatggcatacagctccattggaggggacacatcactggctttatctggtggaaatgtacctttcccttaagttcctccttagtgccatcacagcaggtgaatgggtgccctacggggccctccttcccccaccaggaacagatggaacctgccacccaggatcctgatctgccctgcactgagcactcagtggataaacactcctccagcccagacacactcctcctcttgggcaggagcaatccagagttgttatttttcttagaaggagcctcttttccctctattttttaaattgaaatataatagctgcatcagccctgaaaagccaaattcaaccacatggctggagaatcatttgtcatggccccgccttctcttctgatactaatggagcttcatgacccacggtcagcccccaaaccaaagttgtcccaacagaggaggccagtgaggcagagacagagctctcccactctcagaccctcttttgtcttcattttcctctcccacttagcacatgtgtgcttgagggtggctgggaatgtgatatacagcaccctgatcctaacaggtgtgattgttacgtaagacgctgatactgggccttgtattgcttttaaagtttcctctgctcagcatcatttcatgccaaagtgctgctatgggctgctttgtgtgcacaaaattgctttttccacctcggaaatgcagctttccctagggggaggcctacaacaggacgaccattctgagccagtgagtctattgcatggtgttttgagaaagggaattttagtgacaccttatgccatttcaagaggagaaatgcaggctggcagagcaatttccagaaatggaatttgcctgcaaatagtataaacaacactaaatttactgtgccaggaaatcttcctgaactccttgaactcatacacacaggtatttgagtcctgaataaagtgttggaaagcactgcagatgcggtcacctgactgaccacctgggttttctattaccagtgaatttcttttattcaccttcccttgaccaagaaattgggtttcttttccctcagcctgcacttactcttctattaagaccagaaaataaaataattttccgttgagtcacaaactcatcatcttgtttggtgttctgctgcctctgaacaaaagtgaatgccagccttcccttgctgggtgtcagagtctgcctcccttgaaaagaggcccctgtagaccccaacacctattcttttctctggttaattacagcagcatctgagaaattccatgcaaaagaagactacaaccagtgtttcagatataccacaagatcaaatttgggcactggtggtccacctcagaagactcttgagtcatatattcagtttctcttgctaatatatgactcgtcttcaccatctcctcaaaacaagagcaaagccaagatagaggaaggtaaaaggaggaggaaaggaaaccaaggcagggagatgttctaagtaggtttgcatttagttacccctcatttcacttaaggctccagacagactccaggtagggaatgcatgctgtctctttctctgtgtctgtctccccatctcctagaggacagagtgccagcgacctctggacaggggcagggctccagccaaggtgcccctgagccagggtcaacatagaatttcctgccccgtgaagggctggcaccagctagcatccccttggctccacatgagtcatgaacacaattgtcagtgggggtctctgctgctcttctggctgaagaatctgtttttcttctgggcttcacttgtagttcctattcaatgtctccatagggcactgagatcaccaagaacattacccagaagctgaagtccaaatgttctagattttgacctctcttgactctggggccacaaagagaaggccccataatccacctctcagccagtatctcccttctttgcacagattcctcccaaccccatagagcctatgtggtgagcatgagggtcgtcttccctctgttctcccatcccagcctctgttttgctgcatgttagcgctgatccagctcctgagatggttaattccacccaatccaagcttatttgcttgcctgactgactccaccactctctcagctatgggggaatattgcattctaatgaaatagggtttggaactcacctggtgctcctcgcaagacaactgacacaaggtgtagggtgtgggggtggacaaaatgcccacctactggataaaagctcactgcaggaaaatgaggtctcctggcataatgcaacaaaaatctcatataattttgatttttaaaaagttgttctcaatttttcattacatcctacttctcagccctctggatgtttcatttttttggacaaagtgtttctttagtggttggggccagggacaggttgagggatatttctcggctcatttataagatataaatattatgaggttgtatgtaaagaaagggcaaacgtacagcagaaggggagcaaatagctacctttcaaggattttgagatttgaaggttaaggaatttttactgctatttttgttcatcagtttcatgtctgttatgttttgagatcctcagaggcctagggttagcgtataccaagaatcctggtgagaggcgttgccatgccttggggtgaattcttccccactagctctctcacccagcctacaagtccttctctcatagatcccagagcaatgggcaccgtccaggaggtacaggagaggactttatgatgcaggaaagaaggaagaagtgggtcccttgcaagtggccagacagggaatgatggtttgactccagaaatcaggaatcaggttcaggtttggataacttctctttaaaatatctccacattgagactcttattttaacaaaatccaaacaaaattaactcagggcttgtgacctaacctttgtaagaaggtgatcaaagagatcctacattaataagcactgcctgtagcaccagctttgtctttttgtcttttgttgtttctttcctgaaccaccctgtacatcatagccaggtctaccccaaatagagcagcagctgatggcttctctgctgtctgtggagggagggctcggctgcagacctatggtgttttgtcagctgttaggtgctacagcccacccagtcagagtacatagacatagcgctttaagggacaaaggacaaacagaactatctttgctttccggaggccatctttttctttccttgaatcctttctgctttaaacttctgaggtttatgcatcccagagaggtcacaccaagccaaagagaaaaaattcatagattgtcccagcctacccaaagggcctgaaaagcctctctaaacaaaactcaagatagctgagaagtatgaatggggttcacagcaaagtccaattgatggcttttgaggctgggacacccccaaactgcccttctgtttttgtagttttgctttcttccacccaccctctctccgcatgctgtaagttaggggagttagtatcttgaacttctaaatgcaaaaggagattttataataagccatgctacctgtaaatacattattgaggtttgcatttttatttttggaggtatgaaagagttgagtagaccaagtcaaaagaggtgtggggatttatgtttatttttatttgtttggggttgtttggttggtggctgggtttcttgtaacagacctattctggaatagcaaagaaggataccttggtgatctgcaatgtttctgaatctgtttctctttaggaagtgattgccatcaaatttagtgatatgatatttgagtcaaaaatctgaggttatagtaccagctgtcttttctctctggtctcctttttgtcgtctttctctttctgtctaaattggcctctgtcttttcctaaggacttaaaatataacccaaattaatgaagaactgccccaaaacttcagtgaaagccaaggaggtacagaattttttcaggacatctttaaccaatacaaaatttatgtcttaagaagataatttttacaatagtgtagtaatctgataaatgaaaactattggaagtcaatagttttttatattccagctttctgtattcaaacttgtgccttcagcaagcatctcttcactttctttcccttgtcaattgaaacatgaatgtttggctaactcatgatgtaaagtgtctgttaagttaataatacataatttaaagcacttagtctccacaaagcaatttagaaaaatcttcacttgttagatcccatgaagtacctatgaaattctcagcattgctataagcatttgattttttttaaggaaacttcctgtttaatggaatctgaatccaagatttgctttaatttcactctattcttcccattttcccttattcttcttgttgtctctctaattaaaaaaaaaaaaaacctaggcttttttttttctatccagaaagttgggttttcatgatctgagcttccttatgtctccttctctttgtgcaaacttaaaccagtcatagattgtcacccagacatattctccaacccagcattggaaatctgaacgaatcttttctctttttgtcctacaagtttgtcagagatgagaatggattgctgtctacattctacaaccagaccctagactttataccaggctgtgccacttcctcttcacttcactcagaggatggccccaaaactgaaaaggaaatgaaataatcaaatataccaaatccgaatttgactttatttgatgactcaatattttccttccagtactctaatttttttttatggcaatggcctatatggcacaagaaccaccacttaaagcaaatctgttgaacatttttataagggatgagcaagaaaaacacactccaaaattttaaagtgccattaatcaatttttaagaataaaggtaatatgaaatgagggctaaacaatgtaatataactgccagttaaggtagacagtagttgtggtcttagttacatttgatatggagttgtgtaatattaagcagatcccagtggagttagtaaaaacataggtattgagttttaatggctaccaattgggatatatacttagcctgcaggctgaactttagtcagtgtttttctatcatgttgttttgtgaacaagtcaaaatttatacaaagctaccctaagtgctgcaattgcagaggaacttgcctcttcgtgatattagagggcagtccaactccgctcaaactgagtccaagatttgaattcatccagaaaaacaaatggaggagaaaagcctaatgcaccacatgtgtttggcatttcatggctgggacaatggagtagagggtaggaagacaagctgtagaacaaaagcaaagtgaggtagaaagtaacaggtcccagacgaggacagacttagagatgtgtaaccttggatcctctttttcacttagaatatgggtaaacttcttagcacaagactggattaagagaagttctttctgttaaactcacctagggtagtggctttgaaggcctcagaggattaatagattcccaaaattttcttccagacctgggagatggagagaaagaggttcttgctttaaagcggctcgaagacaatctttatgacttcagcaactcttcaacatagtagcaccaataaaggagagattatgttaacttcctagtggtgagaataccatgggatgggagaagggccagtgagtgggatgggaatgagcttcatcaggaacagatttcagactctgcagggtgcaccggttctagcctcaaataacaacattgcaaggaggtggactacagggtccacaccctctgtccttcggggcccatggtcaggccattccctctttgttttgctcctagaggatgagcatgtaagatgagatcaggagggaaattgggtgctctgcctcaggctgttaaaatgctgctacctgcattctaaaacgtgcaagtcatgccccacaagacacctccttagggcagcatccactgtggtgtgccagcctgacacccctgcagtcacggtgtttgaatggcagctgatgctggcccacccagagtatcggtgcatctctcctaaagccacagttcagcactgcatgttgaccaggcggatatcctataatatagatgctcgtttggatccaaaaggaaaaccattaaaaataaaagaaagatgaaaaactttaatgttttgggggggataaaagaaaagaataaataaaaccttgttgt

SEQ ID NO: 113234 - DNA, 7848 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000352832
  CDS Start-End: 373-7125
ccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcctaaataaaaa

SEQ ID NO: 113235 - DNA, 8138 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000354983
  CDS Start-End: 393-7424
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggcccatcttcagcggagagcgagaaccattttggaaactgtaatgtaacttattttttcctttaacctcgtcatcattttctgtagggaaaaaaaaaagaaaaagaaaaaatgagattttacaagtgaaatggaacctttttatatatacatacatacatatctatctatctatctatatatatataaaataaagtaattttcct

SEQ ID NO: 113236 - DNA, 7030 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000358244
  CDS Start-End: 1-6516
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggccca

SEQ ID NO: 113237 - DNA, 7648 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000359106
  CDS Start-End: 1-7134
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctagtatatgcgggatgtacgacattttgtgactgaagagacttgtttccttctacttttatgtgtctcagaatatttttgaggcgaaggcgtctgtctcttggctattttaacctaaaataacagtctagttatattccctcttcttgcaaagcacaagctgggaccgcgagcacattgcagccccaacggtggccca

SEQ ID NO: 113238 - DNA, 7497 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000360761
  CDS Start-End: 393-7178
ccgccctccgccgctgccccccttttcgttcgccctctcggggcggcttcgccgaaggtagcgccgaatccggcaaccggagcctgggcgcgaagcgaagaagccggaacaaagtgagggggagccggccggctggcccgggaagccccaggggcgcaggggaagcgggactcgcgccgggcggggtttccctgcgccccggcgccccgcgggcagcatgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 113239 - DNA, 4899 bp, Homo sapiens
  Payload ID: 2145
  Gene Symbol: CACNA1G
  Gene Name: calcium channel, voltage-dependent, T type, alpha 1G subunit
  ENST ID: ENST00000416767
  CDS Start-End: 29-4696
atcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggtgagccccaggctcagaggtggggctgtggtgaaggaggctggagggggcacagggccatgcttagtgatacctgctgactccggtggaggtgggctccacgaagagatcagcccttcacaccctctgctgtctaaccaccagcatgtcgcaaagcccagtccatcccacagtgccccaaaaagtgggcccatggggtctctagccgtccttaaagatgaagaaacagaggctcagagagggtaaggggcttgcccagggccacagagctacatggtggagcaggaagcacacgtggcagtgggggcaggcagccctggatgtgaatcctgtgcaaatcctgaccccaccattgtcagctcaatgacctggagcagctgacttaccagggcctcagtttcattaactggtgaatggagtcataatagaatctcctcggaggtcacaat

SEQ ID NO: 113240 - DNA, 7226 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000442258
  CDS Start-End: 176-6907
atgcccctgcgggcagggggagctgggctgaactggccctcccgggggctcagcttgcgccctagagcccaccagatgtgcccccgccggggcccccgggttgcgtgaggacacctcctctgaggggcgccgcttgcccctctccggatcgcccggggccccggctggccagaggatggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 113241 - DNA, 7120 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000429973
  CDS Start-End: 1-6801
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccactttcccactcacctttctccactgggtgccaagtcctagctcctcctcctgggctatattcctgacaaaagttccatatagacaccaaggaggcggaggcgctcctccctgcctcagtggctctgggtacctgcaagcagaacttccaaagagagttaaaagcagcagccccggcaactctggctccaggcagaaggagaggcccggtgcagctgaggttcccgacaccagaagctgttgggagaaagcaatacgtttgtgcagaatctctatgtatattctattttattaaattaattgaatctag

SEQ ID NO: 113242 - DNA, 7116 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000507336
  CDS Start-End: 1-7101
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113243 - DNA, 6600 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000507896
  CDS Start-End: 1-6585
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113244 - DNA, 6633 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000505165
  CDS Start-End: 1-6618
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113245 - DNA, 6699 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000514717
  CDS Start-End: 1-6684
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113246 - DNA, 6849 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000507609
  CDS Start-End: 1-6834
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113247 - DNA, 7014 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000507510
  CDS Start-End: 1-6999
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113248 - DNA, 6960 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000515411
  CDS Start-End: 1-6945
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113249 - DNA, 6891 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000514079
  CDS Start-End: 1-6876
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113250 - DNA, 6731 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000511768
  CDS Start-End: 1-5241
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacgctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113251 - DNA, 6788 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000504076
  CDS Start-End: 1-5298
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113252 - DNA, 6735 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000513964
  CDS Start-End: 1-6720
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113253 - DNA, 6921 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000502264
  CDS Start-End: 1-6921
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatccctctagctgagatggaggctctgtctctgacgtcagagattgtgtctgaaccgtcctgctctctagctctgacggatgactctttgcctgatgacatgcacacactcttacttagtgccctggagagcaatatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctga

SEQ ID NO: 113254 - DNA, 6795 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000514181
  CDS Start-End: 1-6780
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113255 - DNA, 6870 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000515165
  CDS Start-End: 1-6855
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113256 - DNA, 6879 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000513689
  CDS Start-End: 1-6864
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113257 - DNA, 6981 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000515765
  CDS Start-End: 1-6966
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113258 - DNA, 6837 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000512389
  CDS Start-End: 1-6822
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113259 - DNA, 6821 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000506406
  CDS Start-End: 1-5331
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113260 - DNA, 6698 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000503607
  CDS Start-End: 1-5208
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113261 - DNA, 6714 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000510366
  CDS Start-End: 1-6699
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113262 - DNA, 6912 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000510115
  CDS Start-End: 1-6897
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggagtaaggagaagcagatggctgaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacggacaggcagctgtttgacaccatatccctgctgatccagggctccctggagtgggagctgaagctgatggacgagctggcaggcccagggggccagccctctgccttcccttctgcccccagcctgggaggctccgacccacagatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113263 - DNA, 6752 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000503436
  CDS Start-End: 1-5262
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggagggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113264 - DNA, 6768 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000503485
  CDS Start-End: 1-6753
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagaacttccacaagtgtcggcagcaccaggaggaagaggaggcccggcggcgggaggagaagcgcctacgaagactggagaaaaagagaaggaatctaatgctggacgatgtaattgcttccggcagctcagccagcgctgcgtcagaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccaggtggggaacctgggacttctcttcatgttgttgtttttcatctttgcagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113265 - DNA, 6767 bp, Homo sapiens
  Payload ID: 2145
  Gene Symbol: CACNA1G
  Gene Name: calcium channel, voltage-dependent, T type, alpha 1G subunit
  Uniprot ID: O43497
  ENST ID: ENST00000511765
  CDS Start-End: 1-5277
atggacgaggaggaggatggagcgggcgccgaggagtcgggacagccccggagcttcatgcggctcaacgacctgtcgggggccgggggccggccggggccggggtcagcagaaaaggacccgggcagcgcggactccgaggcggaggggctgccgtacccggcgctggccccggtggttttcttctacttgagccaggacagccgcccgcggagctggtgtctccgcacggtctgtaacccctggtttgagcgcatcagcatgttggtcatccttctcaactgcgtgaccctgggcatgttccggccatgcgaggacatcgcctgtgactcccagcgctgccggatcctgcaggcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatcgtgggctccttcttcatgatcaacctgtgcctggtggtgattgccacgcagttctcagagaccaagcagcgggaaagccagctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctctcgggcagcaggtgtgcgggttgggctgctcagcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgcacagcttctaccatgccgactgccacttagagccagtccgctgccaggcgccccctcccaggtccccatctgaggcatccggcaggactgtgggcagcgggaaggtgtatcccaccgtgcacaccagccctccaccggagacgctgaaggagaaggcactagtagaggtggctgccagctctgggcccccaaccctcaccagcctcaacatcccacccgggccctacagctccatgcacaagctgctggagacacagagtacaggtgcctgccaaagctcttgcaagatctccagcccttgcttgaaagcagacagtggagcctgtggtccagacagctgcccctactgtgcccgggccggggcaggggaggtggagctcgccgaccgtgaaatgcctgactcagacagcgaggcagtttatgagttcacacaggatgcccagcacagcgacctccgggacccccacagccggcggcaacggagcctgggcccagatgcagagcccagctctgtgctggccttctggaggctaatctgtgacaccttccgaaagattgtggacagcaagtactttggccggggaatcatgatcgccatcctggtcaacacactcagcatgggcatcgaataccacgagcagcccgaggagcttaccaacgccctagaaatcagcaacatcgtcttcaccagcctctttgccctggagatgctgctgaagctgcttgtgtatggtccctttggctacatcaagaatccctacaacatcttcgatggtgtcattgtggtcatcagcgtgtgggagatcgtgggccagcaggggggcggcctgtcggtgctgcggaccttccgcctgatgcgtgtgctgaagctggtgcgcttcctgccggcgctgcagcggcagctggtggtgctcatgaagaccatggacaacgtggccaccttctgcatgctgcttatgctcttcatcttcatcttcagcatcctgggcatgcatctcttcggctgcaagtttgcctctgagcgggatggggacaccctgccagaccggaagaattttgactccttgctctgggccatcgtcactgtctttcagatcctgacccaggaggactggaacaaagtcctctacaatggtatggcctccacgtcgtcctgggcggccctttatttcattgccctcatgaccttcggcaactacgtgctcttcaatttgctggtcgccattctggtggagggcttccaggcggaggaaatcagcaaacgggaagatgcgagtggacagttaagctgtattcagctgcctgtcgactcccaggggggagatgccaacaagtccgaatcagagcccgatttcttctcacccagcctggatggtgatggggacaggaagaagtgcttggccttggtgtccctgggagagcacccggagctgcggaagagcctgctgccgcctctcatcatccacacggccgccacacccatgtcgctgcccaagagcaccagcacgggcctgggcgaggcgctgggccctgcgtcgcgccgcaccagcagcagcgggtcggcagagcctggggcggcccacgagatgaagtcaccgcccagcgcccgcagctctccgcacagcccctggagcgctgcaagcagctggaccagcaggcgctccagccggaacagcctcggccgtgcacccagcctgaagcggagaagcccaagtggagagcggcggtccctgttgtcgggagaaggccaggagagccaggatgaagaggagagctcagaagaggagcgggccagccctgcgggcagtgaccatcgccacagggggtccctggagcgggaggccaagagttcctttgacctgccagacacactgcaggtgccagggctgcatcgcactgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcagcccatcatgaaccacaacccctggatgctgctgtacttcatctcgttcctgctcattgtggccttctttgtcctgaacatgtttgtgggtgtggtggtggagaacttccacaagtgtcggcagcaccaggaggaagaggaggcccggcggcgggaggagaagcgcctacgaagactggagaaaaagagaaggaaagcccagtgcaaaccttactactccgactactcccgcttccggctcctcgtccaccacttgtgcaccagccactacctggacctcttcatcacaggtgtcatcgggctgaacgtggtcaccatggccatggagcactaccagcagccccagattctggatgaggctctgaagatctgcaactacatcttcactgtcatctttgtcttggagtcagttttcaaacttgtggcctttggtttccgtcggttcttccaggacaggtggaaccagctggacctggccattgtgctgctgtccatcatgggcatcacgctggaggaaatcgaggtcaacgcctcgctgcccatcaaccccaccatcatccgcatcatgagggtgctgcgcattgcccgagtgctgaagctgctgaagatggctgtgggcatgcgggcgctgctggacacggtgatgcaggccctgccccagctctgggcgtggagctctttggagacctggagtgtgacgagacacacccctgtgagggcctgggccgtcatgccacctttcggaactttggcatggccttcctaaccctcttccgagtctccacaggtgacaattggaatggcattatgaaggacaccctccgggactgtgaccaggagtccacctgctacaacacggtcatctcgcctatctactttgtgtccttcgtgctgacggcccagttcgtgctagtcaacgtggtgatcgccgtgctgatgaagcacctggaggagagcaacaaggaggccaaggaggaggccgagctagaggctgagctggagctggagatgaagaccctcagcccccagccccactcgccactgggcagccccttcctctggcctggggtcgagggccccgacagccccgacagccccaagcctggggctctgcacccagcggcccacgcgagatcagcctcccacttttccctggagcaccccacgatgcagccccaccccacggagctgccaggaccagacttactgactgtgcggaagtctggggtcagccgaacgcactctctgcccaatgacagctacatgtgtcggcatgggagcactgccgaggggcccctgggacacaggggctgggggctccccaaagctcagtcaggctccgtcttgtccgttcactcccagccagcagataccagctacatcctgcagcttcccaaagatgcacctcatctgctccagccccacagcgccccaacctggggcaccatccccaaactgcccccaccaggacgctcccctttggctcagaggccactcaggcgccaggcagcaataaggactgactccttggacgttcagggtctgggcagccgggaagacctgctggcagaggtgagtgggccctccccgcccctggcccgggcctactctttctggggccagtcaagtacccaggcacagcagcactcccgcagccacagcaagatctccaagcacatgaccccgccagccccttgcccaggcccagaacccaactggggcaagggccctccagagaccagaagcagcttagagttggacacggagctgagctggatttcaggagacctcctgccccctggcggccaggaggagcccccatccccacgggacctgaagaagtgctacagcgtggaggcccagagctgccagcgccggcctacgtcctggctggatgagcagaggagacactctatcgccgtcagctgcctggacagcggctcccaaccccacctgggcacagacccctctaaccttgggggccagcctcttggggggcctgggagccggcccaagaaaaaactcagcccgcctagtatcaccatagacccccccgagagccaaggtcctcggaccccgcccagccctggtatctgcctccggaggagggctccgtccagcgactccaaggatcccttggcctctggcccccctgacagcatggctgcctcgccctccccaaagaaagatgtgctgagtctctccggtttatcctctgacccagcagacctggacccctgagtcctgccccacttt

SEQ ID NO: 113266 - DNA, 1478 bp, Homo sapiens
  Payload ID: 2145
  Gene Symbol: CACNA1G
  Gene Name: calcium channel, voltage-dependent, T type, alpha 1G subunit
  ENST ID: ENST00000506520
  CDS Start-End: 1-1014
actgccagtggccgagggtctgcttctgagcaccaggactgcaatggcaagtcggcttcagggcgcctggcccgggccctgcggcctgatgaccccccactggatggggatgacgccgatgacgagggcaacctgagcaaaggggaacgggtccgcgcgtggatccgagcccgactccctgcctgctgcctcgagcgagactcctggtcagcctacatcttccctcctcagtccaggttccgcctcctgtgtcaccggatcatcacccacaagatgttcgaccacgtggtccttgtcatcatcttccttaactgcatcaccatcgccatggagcgccccaaaattgacccccacagcgctgaacgcatcttcctgaccctctccaattacatcttcaccgcagtctttctggctgaaatgacagtgaaggtggtggcactgggctggtgcttcggggagcaggcgtacctgcggagcagttggaacgtgctggacgggctgttggtgctcatctccgtcatcgacattctggtgtccatggtctctgacagcggcaccaagatcctgggcatgctgagggtgctgcggctgctgcggaccctgcgcccgctcagggtgatcagccgggcgcaggggctgaagctggtggtggagacgctgatgtcctcactgaaacccatcggcaacattgtagtcatctgctgtgccttcttcatcattttcggcatcttgggggtgcagctcttcaaagggaagtttttcgtgtgccagggcgaggataccaggaacatcaccaataaatcggactgtgccgaggccagttaccggtgggtccggcacaagtacaactttgacaaccttggccaggccctgatgtccctgttcgttttggcctccaaggatggttgggtggacatcatgtacgatgggctggatgctgtgggcgtggaccagcaggtagggctgaggtgggcaggatccatctgtgggctcaggtcactcagcatgggctgattccaggacagaaagagcaaggcagggtggcaaaatgccatgaaagaagcatcatattttacagcagaggctgttgctggtagcctgtgggccaaatctgggcatgttttattggtctacaacatgtttaacatgttttgaattagtgatgaatatttttaaactggtgaatttgggctgtgtgcagtggctcacacctgtaatgccagtgcattgggaggcctaggcaagaggatcacttgaggccaggagttggagaccagcctgggcatcatagcaagacccccagctctacaaaaaataaaaacaattagccgggtgtggtggtatcatctggagtcccagctgaggtgggaggatctcttgagcccaggagtttgaggctgcaataagctgtgatcgcaccactgcactccagcctaagcaatagaacaagaccctgtctctaaaaaaagaaaaaataa

SEQ ID NO: 113267 - DNA, 1255 bp, Homo sapiens
  Payload ID: 2145
  Gene Symbol: CACNA1G
  Gene Name: calcium channel, voltage-dependent, T type, alpha 1G subunit
  ENST ID: ENST00000570567
  CDS Start-End: 1-834
gcctttgatgacttcatctttgccttctttgccgtggagatggtggtgaagatggtggccttgggcatctttgggaaaaagtgttacctgggagacacttggaaccggcttgactttttcatcgtcatcgcagggatgctggagtactcgctggacctgcagaacgtcagcttctcagctgtcaggacagtccgtgtgctgcgaccgctcagggccattaaccgggtgcccagcatgcgcatccttgtcacgttgctgctggatacgctgcccatgctgggcaacgtcctgctgctctgcttcttcgtcttcttcatcttcggcatcgtcggcgtccagctgtgggcagggctgcttcggaaccgatgcttcctacctgagaatttcagcctccccctgagcgtggacctggagcgctattaccagacagagaacgaggatgagagccccttcatctgctcccagccacgcgagaacggcatgcggtcctgcagaagcgtgcccacgctgcgcggggacgggggcggtggcccaccttgcggtctggactatgaggcctacaacagctccagcaacaccacctgtgtcaactggaaccagtactacaccaactgctcagcgggggagcacaaccccttcaagggcgccatcaactttgacaacattggctatgcctggatcgccatcttccaggtcatcacgctggagggctgggtcgacatcatgtactttgtgatggatgctcattccttctacaatttcatctacttcatcctcctcatcatctttttagctctcaggacaagtcctgtagagagggcatccatcatatagtaggagggacaccagatgcagagtcaggaggaaatccaaggtcaaggcgggacttaactgctattgggaccttgggcaagtcattctccatgaggcctccagcactgctctgggcctctgtttcttcatgggtaaaatgaatggttctcaacctgagatgataccacctctcccagagggcatttggaaatgggaaagggtgattctggttttgattttttttaatagctttattgagacataactcacatatcattcaattcatccctttgaatgaatccagtggttttttaagcatgtttacagagttctgtttttttgtaaggacaaggggagtgcaattggcaatttgttactgggggaggggagagaagctaaacatcctgaaatgcttgcaaataaagaattattctacccaaaa

SEQ ID NO: 113268 - DNA, 8084 bp, Homo sapiens
  Payload ID: 2146
  Gene Symbol: CACNA1H
  Gene Name: calcium channel, voltage-dependent, T type, alpha 1H subunit
  Uniprot ID: O95180
  ENST ID: ENST00000348261
  CDS Start-End: 249-7310
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagcactttccccagcccagaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaa

SEQ ID NO: 113269 - DNA, 8069 bp, Homo sapiens
  Payload ID: 2146
  Gene Symbol: CACNA1H
  Gene Name: calcium channel, voltage-dependent, T type, alpha 1H subunit
  Uniprot ID: O95180
  ENST ID: ENST00000358590
  CDS Start-End: 249-7292
cgaggccgccgccgtcgcctccgccgggcgagccggagccggagtcgagccgcggccgggagccgggcgggctggggacgcgggccgggggcggaggcgctgggggccggggccggggccgggggcggaggcgctgggggccggggccggggccgggcgccgagcggggtccgcggtgaccgcgccgcccgggcgatgcccgcggggacgccgccggccagcagagcgaggtgctgccggccgccaccatgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggaaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaagaaatgc

SEQ ID NO: 113270 - DNA, 3325 bp, Homo sapiens
  Payload ID: 2146
  Gene Symbol: CACNA1H
  Gene Name: calcium channel, voltage-dependent, T type, alpha 1H subunit
  ENST ID: ENST00000562079
  CDS Start-End: 1-3235
gccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggaaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttggagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctg

SEQ ID NO: 113271 - DNA, 3391 bp, Homo sapiens
  Payload ID: 2146
  Gene Symbol: CACNA1H
  Gene Name: calcium channel, voltage-dependent, T type, alpha 1H subunit
  ENST ID: ENST00000569107
  CDS Start-End: 1-3301
gccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagtaaggcgctcccggtggcggtggcggtggcggaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctg

SEQ ID NO: 113272 - DNA, 3464 bp, Homo sapiens
  Payload ID: 2146
  Gene Symbol: CACNA1H
  Gene Name: calcium channel, voltage-dependent, T type, alpha 1H subunit
  ENST ID: ENST00000564927
  CDS Start-End: 1-2693
tcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggaaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctgacttgggtcccgtcgtgagcagaaaggcccggggaggatgacggcccaggccctggttctctgcccagcgaagcaggagtagctgccgggccccacgagcctccgtccgttctggttcgggtttctccgagttttgctaccagccgaggctgtgcgggcaactgggtcagcctcccgtcaggagagaagccgcgtctgtgggacgaagaccgggcacccgccagagaggggaaggtaccaggttgcgtcctttcaggccccgcgttgttacaggacactcgctgggggccctgtgcccttgccggcggcaggttgcagccaccgcggcccaatgtcaccttcactcacagtctgagttcttgtccgcctgtcacgccctcaccaccctccccttccagccaccaccctttccgttccgctcgggccttcccagaagcgtcctgtgactctgggagaggtgacacctcactaaggggccgaccccatggagtaacgcgcccggccccgatgcgaatcaggcctcccctacatctgggggcgttggccgcgagattcccattgacacctttgtttcgtgtgcttttaaattcaggttaaatgttgcaataatctgatgcagaagactcagcttctcaagggagagggagggggcggagcggaataaatagtaacttatttaag

SEQ ID NO: 113273 - DNA, 7134 bp, Homo sapiens
  Payload ID: 2146
  Gene Symbol: CACNA1H
  Gene Name: calcium channel, voltage-dependent, T type, alpha 1H subunit
  Uniprot ID: O95180
  ENST ID: ENST00000565831
  CDS Start-End: 1-7044
atgaccgagggcgcacgggccgccgacgaggtccgggtgcccctgggcgcgccgccccctggccctgcggcgttggtgggggcgtccccggagagccccggggcgccgggacgcgaggcggagcgggggtccgagctcggcgtgtcaccctccgagagcccggcggccgagcgcggcgcggagctgggtgccgacgaggagcagcgcgtcccgtacccggccttggcggccacggtcttcttctgcctcggtcagaccacgcggccgcgcagctggtgcctccggctggtctgcaacccatggttcgagcacgtgagcatgctggtaatcatgctcaactgcgtgaccctgggcatgttccggccctgtgaggacgttgagtgcggctccgagcgctgcaacatcctggaggcctttgacgccttcattttcgccttttttgcggtggagatggtcatcaagatggtggccttggggctgttcgggcagaagtgttacctgggtgacacgtggaacaggctggatttcttcatcgtcgtggcgggcatgatggagtactcgttggacggacacaacgtgagcctctcggctatcaggaccgtgcgggtgctgcggcccctccgcgccatcaaccgcgtgcctagcatgcggatcctggtcactctgctgctggatacgctgcccatgctcgggaacgtccttctgctgtgcttcttcgtcttcttcattttcggcatcgttggcgtccagctctgggctggcctcctgcggaaccgctgcttcctggacagtgcctttgtcaggaacaacaacctgaccttcctgcggccgtactaccagacggaggagggcgaggagaacccgttcatctgctcctcacgccgagacaacggcatgcagaagtgctcgcacatccccggccgccgcgagctgcgcatgccctgcaccctgggctgggaggcctacacgcagccgcaggccgagggggtgggcgctgcacgcaacgcctgcatcaactggaaccagtactacaacgtgtgccgctcgggtgactccaacccccacaacggtgccatcaacttcgacaacatcggctacgcctggattgccatcttccaggtgatcacgctggaaggctgggtggacatcatgtactacgtcatggacgcccactcattctacaacttcatctatttcatcctgctcatcatcgtgggctccttcttcatgatcaacctgtgcctggtggtgattgccacgcagttctcggagacgaagcagcgggagagtcagctgatgcgggagcagcgggcacgccacctgtccaacgacagcacgctggccagcttctccgagcctggcagctgctacgaagagctgctgaagtacgtgggccacatattccgcaaggtcaagcggcgcagcttgcgcctctacgcccgctggcagagccgctggcgcaagaaggtggaccccagtgctgtgcaaggccagggtcccgggcaccgccagcgccgggcaggcaggcacacagcctcggtgcaccacctggtctaccaccaccatcaccaccaccaccaccactaccatttcagccatggcagcccccgcaggcccggccccgagccaggcgcctgcgacaccaggctggtccgagctggcgcgcccccctcgccaccttccccaggccgcggaccccccgacgcagagtctgtgcacagcatctaccatgccgactgccacatagaggggccgcaggagagggcccgggtggcacatgccgcagccactgccgctgccagcctcagactggccacagggctgggcaccatgaactaccccacgatcctgccctcaggggtgggcagcggcaaaggcagcaccagccccggacccaaggggaagtgggccggtggaccgccaggcaccggggggcacggcccgttgagcttgaacagccctgatccctacgagaagatcccgcatgtggtcggggagcatggactgggccaggcccctggccatctgtcgggcctcagtgtgccctgccccctgcccagccccccagcgggcacactgacctgtgagctgaagagctgcccgtactgcacccgtgccctggaggacccggagggtgagctcagcggctcggaaagtggagactcagatggccgtggcgtctatgaattcacgcaggacgtccggcacggtgaccgctgggaccccacgcgaccaccccgtgcgacggacacaccaggcccaggcccaggcagcccccagcggcgggcacagcagagggcagccccgggcgagccaggctggatgggccgcctctgggttaccttcagcggcaagctgcgccgcatcgtggacagcaagtacttcagccgtggcatcatgatggccatccttgtcaacacgctgagcatgggcgtggagtaccatgagcagcccgaggagctgactaatgctctggagatcagcaacatcgtgttcaccagcatgtttgccctggagatgctgctgaagctgctggcctgcggccctctgggctacatccggaacccgtacaacatcttcgacggcatcatcgtggtcatcagcgtctgggagatcgtggggcaggcggacggtggcttgtctgtgctgcgcaccttccggctgctgcgtgtgctgaagctggtgcgctttctgccagccctgcggcgccagctcgtggtgctggtgaagaccatggacaacgtggctaccttctgcacgctgctcatgctcttcattttcatcttcagcatcctgggcatgcaccttttcggctgcaagttcagcctgaagacagacaccggagacaccgtgcctgacaggaagaacttcgactccctgctgtgggccatcgtcaccgtgttccagatcctgacccaggaggactggaacgtggtcctgtacaacggcatggcctccacctcctcctgggccgccctctacttcgtggccctcatgaccttcggcaactatgtgctcttcaacctgctggtggccatcctcgtggagggcttccaggcggagggcgatgccaacagatccgacacggacgaggacaagacgtcggtccacttcgaggaggacttccacaagctcagagaactccagaccacagagctgaagatgtgttccctggccgtgacccccaacgggcacctggagggacgaggcagcctgtcccctcccctcatcatgtgcacagctgccacgcccatgcctacccccaagagctcaccattcctggatgcagcccccagcctcccagactctcggcgtggcagcagcagctccggggacccgccactgggagaccagaagcctccggccagcctccgaagttctccctgtgccccctggggccccagtggcgcctggagcagccggcgctccagctggagcagcctgggccgtgcccccagcctcaagcgccgcggccagtgtggggaacgtgagtccctgctgtctggcgagggcaagggcagcaccgacgacgaagctgaggacggcagggccgcgcccgggccccgtgccaccccactgcggcgggccgagtccctggacccacggcccctgcggccggccgccctcccgcctaccaagtgccgcgatcgcgacgggcaggtggtggccctgcccagcgacttcttcctgcgcatcgacagccaccgtgaggatgcagccgagcttgacgacgactcggaggacagctgctgcctccgcctgcataaagtgctggagccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggaaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttgggctccgttgcctctgtgcactctccgcccgcagagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctg

SEQ ID NO: 113274 - DNA, 3343 bp, Homo sapiens
  Payload ID: 2146
  Gene Symbol: CACNA1H
  Gene Name: calcium channel, voltage-dependent, T type, alpha 1H subunit
  ENST ID: ENST00000564231
  CDS Start-End: 1-3253
gccctacaagccccagtggtgccggagccgcgaggcctgggccctctacctcttctccccacagaaccggttccgcgtctcctgccagaaggtcatcacacacaagatgtttgatcacgtggtcctcgtcttcatcttcctcaactgcgtcaccatcgccctggagaggcctgacattgatcccggcagcaccgagcgggtcttcctcagcgtctccaattacatcttcacggccatcttcgtggcggagatgatggtgaaggtggtggccctggggctgctgtccggcgagcacgcctacctgcagagcagctggaacctgctggatgggctgctggtgctggtgtccctggtggacattgtcgtggccatggcctcggctggtggcgccaagatcctgggtgttctgcgcgtgctgcgtctgctgcggaccctgcggcctctgagggtcatcagccgggccccgggcctcaagctggtggtggagacgctgatatcatcactcaggcccattgggaacatcgtcctcatctgctgcgccttcttcatcatttttggcattttgggtgtgcagctcttcaaagggaagttctactactgcgagggccccgacaccaggaacatctccaccaaggcacagtgccgggccgcccactaccgctgggtgcgacgcaagtacaacttcgacaacctgggccaggccctgatgtcgctgttcgtgctgtcatccaaggatggatgggtgaacatcatgtacgacgggctggatgccgtgggtgtcgaccagcagcctgtgcagaaccacaacccctggatgctgctgtacttcatctccttcctgctcatcgtcagcttcttcgtgctcaacatgttcgtgggcgtcgtggtcgagaacttccacaagtgccggcagcaccaggaggcggaggaggcgcggcggcgagaggagaagcggctgcggcgcctagagaggaggcgcaggagcactttccccagcccagaggcccagcgccggccctactatgccgactactcgcccacgcgccgctccattcactcgctgtgcaccagccactatctcgacctcttcatcaccttcatcatctgtgtcaacgtcatcaccatgtccatggagcactataaccaacccaagtcgctggacgaggccctcaagtactgcaactacgtcttcaccatcgtgtttgtcttcgaggctgcactgaagctggtagcatttgggttccgtcggttcttcaaggacaggtggaaccagctggacctggccatcgtgctgctgtcactcatgggcatcacgctggaggagatagagatgagcgccgcgctgcccatcaaccccaccatcatccgcatcatgcgcgtgcttcgcattgcccgtgtgctgaagctgctgaagatggctacgggcatgcgcgccctgctggacactgtggtgcaagctctcccccaggtggggaacctgggccttcttttcatgctcctgttttttatctatgctgcgctgggagtggagctgttcgggaggctggagtgcagtgaagacaacccctgcgagggcctgagcaggcacgccaccttcagcaacttcggcatggccttcctcacgctgttccgcgtgtccacgggggacaactggaacgggatcatgaaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgctctcgctgcccaacgacagctacatgttcaggcccgtggtgcctgcctcggcgccccacccccgcccgctgcaggaggtggagatggagacctatggggccggcacccccttggagtcctgtgcctccctccagatcccattggctgtgtcgtccccagccaggagcggcgagcccctccacgccctgtcccctcggggcacagcccgctcccccagtctcagccggctgctctgcagacaggaggctgtgcacaccgattccttggaagggaagattgacagccctagggacaccctggatcctgcagagcctggtgagaaaaccccggtgaggccggtgacccaggggggctccctgcagtccccaccacgctccccacggcccgccagcgtccgcactcgtaagcataccttcggacagcgctgcgtctccagccggccggcggccccaggcggagaggaggccgaggcctcggacccagccgacgaggaggtcagccacatcaccagctccgcctgcccctggcagcccacagccgagccccatggccccgaagcctctccggtggccggcggcgagcgggacctgcgcaggctctacagcgtggatgctcagggcttcctggacaagccgggccgggcagacgagcagtggcggccctcggcggagctgggcagcggggagcctggggaggcgaaggcctggggccctgaggccgagcccgctctgggtgcgcgcagaaagaagaagatgagccccccctgcatctcggtggaaccccctgcggaggacgagggctctgcgcggccctccgcggcagagggcggcagcaccacactgaggcgcaggaccccgtcctgtgaggccacgcctcacagggactccctggagcccacagagggctcaggcgccgggggggaccctgcagccaagggggagcgctggggccaggcctcctgccgggctgagcacctgaccgtccccagctttgcctttgagccgctggacctcggggtccccagtggagaccctttcttggacggtagccacagtgtgaccccagaatccagagcttcctcttcaggggccatagtgcccctggaacccccagaatcagagcctcccatgcccgtcggtgaccccccagagaagaggcgggggctgtacctcacagtcccccagtgtcctctggagaaaccagggtccccctcagccacccctgccccagggggtggtgcagatgaccccgtgtagctcggggcttggtgccgcccacggctttggccctggggtctgggggccccgctggggtggaggcccaggcagaaccctgcatggaccctg

SEQ ID NO: 113275 - DNA, 6740 bp, Homo sapiens
  Payload ID: 2147
  Gene Symbol: CACNA1I
  Gene Name: calcium channel, voltage-dependent, T type, alpha 1I subunit
  Uniprot ID: Q9P0X4
  ENST ID: ENST00000401624
  CDS Start-End: 1-6051
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagagagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggtaccgacacctcccaggccctagagcactggtctgtgggcaaggggcaggatctaagccaggcctggaagtccaagggactgggaggggaaggacccaaccaaaggccgagggcaccaccgtgcaagggggtttgggaacgctggggtgacgctgagactggagggggaggtggcactggggcggatggagtgggcggggctgggtcctggggacagcagagtgtggggaggaccccaaggcgggtctggaagaggcctgtgatccctagcttgaggggaggggaggagaggaggaggagtactggaggttttgcagggtggcggggtgctggcagtggggaggacaccctgggtgctctgggtgggtgtgagtgggggcttgattactaggaatggaggtgggagggcgggtctggtggatgagaagcctcgggctgcagggtcccccgtactggattggccagggccacagccctcctacccacgggcacacagaggtctgaagcactgagggctccgctgtgggggtggggaaatggggccgggccggctcccacagtgagtgcagttgattcactgggtgactgtctgacccgtcacaccaggctgtgtgctctggcgggcaggacacaaactccctgcctgccgggctcactgtttagtgctgagagtgagctgcctgggtgcaggagggatgataaccaaaataaa

SEQ ID NO: 113276 - DNA, 9892 bp, Homo sapiens
  Payload ID: 2147
  Gene Symbol: CACNA1I
  Gene Name: calcium channel, voltage-dependent, T type, alpha 1I subunit
  Uniprot ID: Q9P0X4
  ENST ID: ENST00000404898
  CDS Start-End: 1-6567
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctattt

SEQ ID NO: 113277 - DNA, 10004 bp, Homo sapiens
  Payload ID: 2147
  Gene Symbol: CACNA1I
  Gene Name: calcium channel, voltage-dependent, T type, alpha 1I subunit
  Uniprot ID: Q9P0X4
  ENST ID: ENST00000402142
  CDS Start-End: 1-6672
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccatgggaagactaagggtcagggagatgaagggagacatctcggaagccggcattgccagactttgcatgggcctgcctcccctggaaatgatcactcgggaagagagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggccaccgggagcgacacgtcgctggacgccagccccagcagctccgcgggcagcctgcagaccacgctcgaggacagcctgaccctgagcgacagcccccggcgtgccctggggccgcccgcgcctgctccaggaccccgggccggcctgtcccccgccgctcgccgccgcctgagcctgcgcggccggggcctcttcagcctgcgggggctgcgggcgcatcagcgcagccacagcagcgggggctccaccagcccgggctgcacccaccacgactccatggacccctcggacgaggagggccgcggtggcgcgggcggcgggggcgcgggcagcgagcactcggagaccctcagcagcctctcgctcacctccctcttctgcccgccgcccccgccgccagcccccggcctcacgcccgccaggaagttcagcagcaccagcagcctggccgcccccggccgcccccacgccgccgccctggcccacggcctggcccggagcccctcgtgggccgcggaccgcagcaaggacccccccggccgggcaccgctgcccatgggcctgggccccttggcgcccccgccgcaaccgctccccggagagctggagccgggagacgccgccagcaagaggaagagatgagggtcgcaggggcccccggccgcccaccgcccgccccgtctcaccttctttacctcaggagccaggagcagacagcaatacttcgtccacacctgggatcgcgcagggcccgcagggcacaggcgcccgacagccgggctgagcggagtctgggttagccaggcctgcgtggcccatggtggcccttccagtgcatatacatacatatatatatatatatgcatatatatatatatatatatatatatgtgtatacacacacacatagacagacatatatatatatatttattttttttactgagagcttatgacttccagaaagtgctaaaggtgggaggtgggccagggcctggacggggcttttgtctgatgctctgggattctggccagacccaccccagggcacatgtcctgcgggggcgtcccagctgtgttttttgatgtctcctccctggttaagagtagcttggagaggaccctcaggcctctgagggcaccaggccctggagaagaggtgcaattcagggtgtgtgtgtgttttttttcctttaaagaagaaacgctgctaagatcccacgtggctcccacgtgtcggggtgtctgtcctgtcatcctgactgtctcgttattgtgaagtctttcgtagacaccccagagcacacacatccccttagtccaccggttagatgtctctctttagaaaaatcaggggtgagtagctgtgtttccttaggcctggggtaggggatggagagcagctccaaggctgagctggggctctggccccaggtgaggtccccagctcctgagcacttctgagggggtgggttccacccccaggagggcgggggtgggtggagcaggagtggaggcagcctgcagaggaagggtgcgggagactgagccggcagtggcttgcttggaggggctagggtacccgcctggtctcggctggctccagctgccctgcaggtgcccctgggctcaggtagttagttgttcagccactaatgccttttatcccccatatgggcgctgagctgtggctgttcctggacactgtgctgtccccgtcctgagcaactatgcccccgccccagtaggttcaaggcaaagcagctctgaccgaattctaggcaggggtgggggcacctgcctgggccctgggtccagccgcatccccatgcccagcctttcgcgtcacctggaggccacatcttcccaccccacctgccagcccctgtctctcctccccgctgcccctaactgcagctcagctttcactatagcagtgcttcccaaacgggttctagacttgggtgtttgatttgaagagttacgcatttatttcactatttattgggaaaaaaatgcattgaacccgtgatttcacagacattttgcttaggtcaaggctactttttaaaaagggagtgactttcatgaagtcagtttgaagaaggaggttgggagcatgttggtggcagtgatctggagaggctgcaggggccacgagtttgcagatgctgtacttcagcaataaccttgcctttgctaagaccccctccgagggcttcaggggggcctgccaagggggggccttgttcttgttcccaaactctgacttggaagaactcagcttgtggccgggctggtgagggtgtggggtgcgcccttcccttttgggctgagggagagggggccgggaggggttgtcaagcccacccgggaaactgagccctggagaggggaagcagccagcccaggatgcttcagggccctggcagcaaagaagctggggtggtgtggagggccctactccacaccctagagctgtgatgctgagcaaggtgcctgtggcggaaggaactgcccagtcctccctgggggcaggtagacctgtggggatggctcggtccaagcccaacactgcccgctccagagagcctcagccctgcctccctttccacagaggtggttttatgtggaacgaggtaccttgtctggggaagaagtggagctgggcaggcttgactgctcctggctgaccctgagctctcgcagttggagggaagcagacagacttgactttttgcaagtccgcgtgttgctggagggacacgtgtattggagcccagaagaggggctgtgtggcctgggaataccatgtggaaggttgggcttcaagttaacaggatcagacaccagtcaagcagcctcaggtcatcttgcgactccactgagcagcctttcctgttgtcacatgggttcagagcagctgagcagggaacacgtcctaggcaggtctgacgtgaaacctccccttaccctgaaccgtgtgactctgcaagcagacacctcgaggcaggtgttctaggcaaagggatgggcatgagcgaaggctccagggtccacagagcagggagtgtggagaaggtggaagagctgagctcagaggcagagaagctccttgcagggagcactgggagatggcctggcccgtcccaggctcctggaggccccacctgccgatcccaggcacttgaccttgttcctgtgggtgacagagatgagaaccagggaagctgtgatccactggccaggacaagtcaacatgggtgagggttgggcaaagggcccttccttcctccccaaccctgtggtctggggccatggcctcaggcttgtgtctatcacaaaagcacaaacttgccctaacccacatgggcctggctgtggggaaagtggggacccaggtccctgagctgtctgctgggctccgtagagcggtggtgggcaggcaccttggcatctgtgcagagacggcccagtctggccaaatcctcttcctctcccctgctctaccttctccggcaccaggcagccccttaaaggaggacaaagtgtgtaaagcccgtctgctgtcttcccccaaatcctcagctcagagccttccgcttccagggccaaccccagccccgtttgctgcgttgtgtaagggcttggggtcttagaagctgctctttagcccagatacacatactcttttttgtctttgtgcaataatcagtgttcctggcagagcctgggccaagctgcagcctactgaggaggcagaggccacctcctccagaaagccctcggcctgggccgccgccgtgactctagcactctcagtcgctgtacagtttctatggtgtgaatgaacttccctcctagttgctgatggcgctggtacctgctggcccatggcccgggtgtagagaaaccaagcggcagccaccaccagtgttgttttgaataaaagcccagaagcctatttaagaatt

SEQ ID NO: 113278 - DNA, 5952 bp, Homo sapiens
  Payload ID: 2147
  Gene Symbol: CACNA1I
  Gene Name: calcium channel, voltage-dependent, T type, alpha 1I subunit
  Uniprot ID: Q9P0X4
  ENST ID: ENST00000407673
  CDS Start-End: 1-5946
atggctgagagcgcctccccgccctcctcatctgcagcagccccagccgctgagccaggagtcaccacggagcagcccggaccccggagccccccatcctccccgccaggcctggaggagcctctggatggagctgatcctcatgtcccacacccagacctggcgcctattgccttcttctgcctgcgacagaccaccagcccccggaactggtgcatcaagatggtgtgcaacccgtggtttgaatgtgtcagcatgctggtgatcctgctgaactgcgtgacacttggcatgtaccagccgtgcgacgacatggactgcctgtccgaccgctgcaagatcctgcaggtctttgatgacttcatctttatcttctttgccatggagatggtgctcaagatggtggccctggggatttttggcaagaagtgctacctcggggacacatggaaccgcctggatttcttcatcgtcatggcagggatggtcgagtactccctggaccttcagaacatcaacctgtcagccatccgcaccgtgcgcgtcctgaggcccctcaaagccatcaaccgcgtgcccagtatgcggatcctggtgaacctgctcctggacacactgcccatgctggggaatgtcctgctgctctgcttctttgtcttcttcatctttggcatcataggtgtgcagctctgggcgggcctgctgcgtaaccgctgcttcctggaggagaacttcaccatacaaggggatgtggccttgcccccatactaccagccggaggaggatgatgagatgcccttcatctgctccctgtcgggcgacaatgggataatgggctgccatgagatccccccgctcaaggagcagggccgtgagtgctgcctgtccaaggacgacgtctacgactttggggcggggcgccaggacctcaatgccagcggcctctgtgtcaactggaaccgttactacaatgtgtgccgcacgggcagcgccaacccccacaagggtgccatcaactttgacaacatcggttatgcttggattgtcatcttccaggtgatcactctggaaggctgggtggagatcatgtactacgtgatggatgctcactccttctacaacttcatctacttcatcctgcttatcatagtgggctccttcttcatgatcaacctgtgcctcgttgtcatagcgacccagttctcggagaccaagcaacgggagcaccggctgatgctggagcagcggcagcgctacctgtcctccagcacggtggccagctacgccgagcctggcgactgctacgaggagatcttccagtatgtctgccacatcctgcgcaaggccaagcgccgcgccctgggcctctaccaggccctgcagagccggcgccaggccctgggcccggaggccccggcccccgccaaacctgggccccacgccaaggagccccggcactaccagctgtgcccgcaacatagccccctggatgcgacgccccacaccctggtgcagcccatccccgccacgctggcttccgatcccgccagctgcccttgctgccagcatgaggacggccggcggccctcgggcctgggcagcaccgactcgggccaggagggctcgggctccgggagctccgctggtggcgaggacgaggcggatggggacggggcccggagcagcgaggacggagcctcctcagaactggggaaggaggaggaggaggaggagcaggcggatggggcggtctggctgtgcggggatgtgtggcgggagacgcgagccaagctgcgcggcatcgtggacagcaagtacttcaaccggggcatcatgatggccatcctggtcaacaccgtcagcatgggcatcgagcaccacgagcagccggaggagctgaccaacatcctggagatctgcaatgtggtcttcaccagcatgtttgccctggagatgatcctgaagctggctgcatttgggctcttcgactacctgcgtaacccctacaacatcttcgacagcatcattgtcatcatcagcatctgggagattgtggggcaggcggacggtgggctgtcggtgctgcggaccttccggctgctgcgcgtgctgaaactggtgcgcttcatgcctgccctgcggcgccagctcgtggtgctcatgaagaccatggacaacgtggccaccttctgcatgctgctcatgctcttcatcttcatcttcagcatccttgggatgcatatttttggctgcaagttcagcctccgcacggacactggagacacggtgcccgacaggaagaacttcgactccctgctgtgggccatcgtcactgtgttccagatcctcacccaggaggactggaacgtcgttctctacaatggcatggcctccacttctccctgggcctccctctactttgtcgccctcatgaccttcggcaactatgtgctcttcaacctgctggtggccatcctggtggagggcttccaggcggagggtgacgccaatcgctcctactcggacgaggaccagagctcatccaacatagaagagtttgataagctccaggaaggcctggacagcagcggagatcccaagctctgcccaatccccatgacccccaatgggcacctggaccccagtctcccactgggtgggcacctaggtcctgctggggctgcgggacctgccccccgactctcactgcagccggaccccatgctggtggccctgggctcccgaaagagcagtgtcatgtctctagggaggatgagctatgaccagcgctccctgtccagctcccggagctcctactacgggccatggggccgcagcgcggcctgggccagccgtcgctccagctggaacagcctcaagcacaagccgccgtcggcggagcatgagtccctgctctctgcggagcgcggcggcggcgcccgggtctgcgaggttgccgcggacgaggggccgccgcgggccgcacccctgcacaccccacacgcccaccacattcatcacgggccccatctggcgcaccgccaccgccaccaccgccggacgctgtccctcgacaacagggactcggtggacctggccgagctggtgcccgcggtgggcgcccacccccgggccgcctggagggcggcaggcccggcccccgggcatgaggactgcaatggcaggatgcccagcatcgccaaagacgtcttcaccaagatgggcgaccgcggggatcgcggggaggatgaggaggaaatcgactacaccctgtgcttccgcgtccgcaagatgatcgacgtctataagcccgactggtgcgaggtccgcgaagactggtctgtctacctcttctctcccgagaacaggttccgggtcctgtgtcagaccattattgcccacaaactcttcgactacgtcgtcctggccttcatctttctcaactgcatcaccatcgccctggagcggcctcagatcgaggccggcagcaccgaacgcatctttctcaccgtgtccaactacatcttcacggccatcttcgtgggcgagatgacattgaaggtagtctcgctgggcctgtacttcggcgagcaggcgtacctacgcagcagctggaacgtgctggatggctttcttgtcttcgtgtccatcatcgacatcgtggtgtccctggcctcagccgggggagccaagatcttgggggtcctccgagtcttgcggctcctgcgcaccctacgccccctgcgtgtcatcagccgggcgccgggcctgaagctggtggtggagacactcatctcctccctcaagcccatcggcaacatcgtgctcatctgctgtgccttcttcatcatctttggcatcctgggagtgcagctcttcaagggcaagttctaccactgtctgggcgtggacacccgcaacatcaccaaccgctcggactgcatggccgccaactaccgctgggtccatcacaaatacaacttcgacaacctgggccaggctctgatgtccctctttgtcctggcatccaaggatggttgggtgaacatcatgtacaatggactggatgctgttgctgtggaccagcagcctgtgaccaaccacaacccctggatgctgctgtacttcatctccttcctgctcatcgtcagcttctttgtgctcaacatgtttgtgggtgtcgtggtggagaacttccacaagtgccggcagcaccaggaggctgaagaggcacggcggcgtgaggagaagcggctgcggcgcctggagaagaagcgccggaaggcccagcggctgccctactatgccacctattgtcacacccggctgctcatccactccatgtgcaccagccactacctggacatcttcatcaccttcatcatctgcctcaacgtggtcaccatgtccctggagcactacaatcagcccacgtccctggagacagccctcaagtactgcaactatatgttcaccactgtctttgtgctggaggctgtgctgaagctggtggcatttggtctgaggcgcttcttcaaggaccgatggaaccagctggacctggccattgtgctactgtcagtcatgggcatcaccctggaggagatcgagatcaatgcggccctgcccatcaatcccaccatcatccgcatcatgagggttctgcgcattgcccgagtgctgaagctgttgaagatggccacaggaatgcgggccctgctggacacggtggtgcaagctttgccccaggtgggcaacctgggcctcctcttcatgctgctcttcttcatctatgctgctctcggggtggagctctttgggaagctggtctgcaacgacgagaacccgtgcgagggcatgagccggcatgccaccttcgagaacttcggcatggccttcctcacactcttccaggtctccacgggtgacaactggaacgggatcatgaaggacacgctgcgggactgcacccacgacgagcgcagctgcctgagcagcctgcagtttgtgtcgccgctgtacttcgtgagcttcgtgctcaccgcgcagttcgtgctcatcaacgtggtggtggctgtgctcatgaagcacctggacgacagcaacaaggaggcgcaggaggacgccgagatggatgccgagctcgagctggagatggcccatggcctgggccctggcccgaggctgcctaccggctccccgggcgcccctggccgagggccgggaggggcgggcggcgggggcgacaccgagggcggcttgtgccggcgctgctactcgcctgcccaggagaacctgtggctggacagcgtctctttaatcatcaaggactccttggagggggagctgaccatcatcgacaacctgtcgggctccatcttccaccactactcctcgcctgccggctgcaagaagtgtcaccacgacaagcaagaggtgcagctggctgagacggaggccttctccctgaactcagacaggtcctcgtccatcctgctgggtgacgacctgagtctcgaggaccccacagcctgcccacctggccgcaaagacagcaagggtgagctggacccacctgagcccatgcgtgtgggagacctgggcgaatgcttcttccccttgtcctctacggccgtctcgccggatccagagaacttcctgtgtgagatggaggagatcccattcaaccctgtccggtcctggctgaaacatgacagcagtcaagcacccccaagtcccttctccccggatgcctccagccctctcctgcccatgccagccgagttcttccaccctgcagtgtctgccagccagaaaggcccagaaaagggcactggcactggaaccctccccaagattgcgctgcagggctcctgggcatctctgcggtcaccaagggtcaactgtaccctcctccggcaggtaccgacacctcccaggccctagagcact

SEQ ID NO: 113279 - DNA, 4084 bp, Homo sapiens
  Payload ID: 2148
  Gene Symbol: CHERP
  Gene Name: calcium homeostasis endoplasmic reticulum protein
  ENST ID: ENST00000198939
  CDS Start-End: 38-2821
cgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgggccctgacgcgcggaaagtctctccctcacagccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccaccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaa

SEQ ID NO: 113280 - DNA, 4173 bp, Homo sapiens
  Payload ID: 2148
  Gene Symbol: CHERP
  Gene Name: calcium homeostasis endoplasmic reticulum protein
  Uniprot ID: Q8IWX8
  ENST ID: ENST00000546361
  CDS Start-End: 153-2903
ggagtttcccagcgacggccgtaagtggcgggcggaagcggccctagaagcccgccgtaaacggctccctcgcgccacttccggccggcttccgcagacggcgctggtggtcgatcgtgtggcgccggaggacgttccccgcggccggagccatggagatgccgctgccccccgatgaccaggagcttcgaaatgtcatcgacaagctcgcccagttcgtggctcgcaatgggcccgagtttgagaagatgactatggagaagcagaaggacaaccccaaattctcgtttcttttcggaggcgaattctacagttactacaagtgcaagctggcgctggagcagcagcagctcatctgcaagcagcagaccccggagctggagccagccgccaccatgccacccctgccacagcccccgctggcccccgccgcgcccatcccgccggcccagggcgcgccatccatggacgagctcatccagcagagccagtggaacctccagcagcaggagcagcacttgctggcgctcagacaggagcaagtgacagcggccgtggcccacgcggtggagcagcagatgcagaagcttctggaggagacccagctagacatgaacgagtttgacaacctcctgcagcccatcatcgacacgtgcaccaaggacgccatctcggccgggaagaactggatgttcagcaatgccaagtccccgccgcactgtgagctgatggccggccacctccggaaccgcatcacggctgatggggcacacttcgagctgcggctgcacctcatctacctgatcaatgacgtgctgcaccactgccagcgcaagcaggcccgggagctgctggccgccctgcagaaggtcgtggtgcccatctactgcaccagcttcttggccgtggaggaagacaagcagcagaagatcgcccggctcctgcagctctgggagaaaaacggctacttcgatgactccatcattcagcagctacagagcccagccctggggcttggtcagtaccaggccaccctcatcaacgagtactcctcagtggtccagccggtgcagctggccttccagcagcagatccagaccctcaagacgcagcacgaggagtttgtcaccagcctggcccagcagcagcagcagcagcaacagcagcagcagcagctccagatgccgcagatggaggctgaagtcaaggccacgcctccaccgcctgctccacccccggccccagcacctgcccctgccatcccgcccaccacccagcctgatgacagcaagcctcccatccagatgcctggctcttcagagtacgaagctccaggaggggtccaggatcctgcagctgccggcccccggggccccgggccacacgaccagatcccaccaaacaagcccccttggtttgaccagcctcaccccgtggctccttggggccagcagcagccgccagagcagccaccctacccgcaccaccagggcggcccaccccactgccccccctggaacaacagccatgagggcatgtggggcgagcagcgcggtgaccccggctggaacggccagcgcgacgcgccctggaacaaccagcccgacgccgcctggaacagccagttcgagggcccctggaacagccagcacgagcagccgccctggggcgggggccagcgcgagccacccttccgcatgcagcggcccccacacttccgggggcccttcccgccccaccagcagcacccgcagttcaaccagcctccgcacccccacaacttcaaccgcttcccgccccgcttcatgcaggacgacttcccgccacggcaccccttcgagcggccgccctatccccaccgcttcgactacccccagggggacttccctgccgaaatggggccccctcaccaccaccctggccaccgcatgcctcatcctggcatcaacgagcacccgccttgggctggaccccagcaccctgacttcggccctcccccccatggcttcaacgggcagcccccacacatgcggcgacagggcccaccccacatcaaccacgatgaccccagcctggtccccaatgtgccctacttcgatctccctgctgggctgatggcccccctcgtgaagctggaagatcacgagtacaagcctttggaccctaaagacatccgcctcccaccccccatgccgcccagcgagaggctgctggctgcagtggaggccttctacagccccccgtcccacgacaggcccaggaacagtgaaggctgggagcagaacggcctctatgagttcttccgagcaaaaatgcgggcccggcggaggaaaggccaggagaagaggaacagcggaccctcgaggtctcggagcagatccaagagtcgagggcgttcttcctcccgctccaactcaagatcctccaagtcttcaggctcgtactcaaggtcaaggtcgcgctcctgctcccgttcctactcccgctccagatctagaagtcggagcaggtcgcgctcctccagaagccgctcccggtcccagtcgcggtcccggtccaagtcgtactccccaggaagaagacgccggtcacggtccaggagccccaccccgccttcctctgctggtctgggttctaattcggcgcctcccatccctgactcaaggctcggagaagagaacaaaggccatcagatgctggtgaagatgggctggagcggctcaggcggcctcggtgcgaaggagcaagggatccaggaccccatcaagggcggggacgtccgggataagtgggaccagtataaaggcgtgggcgtggctctggatgacccctatgagaactaccgcaggaacaagagctactccttcatcgcccgcatgaaggccagggacgagtgtaagtaggcgcccatgccgggagccgcgccggtggccagcggtgccggctgtgggaccttcctggctgactggcagaggaagattgcagtgacagctcagttcttacaccgtctccacttgtggagagccacaggaagagaaggaagaccagcgcatgcccagtgggaacgccgtgctccatggcgtggagggcacgggtgccacccacaaaccacaccaggaggcgctgcagccaccagggccccaggctcgttttcctttatagcgaagcaaaaaacacaagaccctccgcccgagtaaattcttcagccacgaagggatggatgtgcatctgccctaagtcagattgaagcctcctcctaggctccaggaggagcatgtgcaggaagggttggcctgagccagagccggcaccccagctccttcctccagctccccgcacccaccggccctgacctggcttcccctcggctgtgtagggacaaagccgaagcccagtgccatgactgcccgcggattgaaaaacagaaacacaaaactttgacttgacttgcgaagtgaagcagggttttcatttttactctccttggtttaggtctagaaagaagaatactgacctgagaggaggcccagtgagattctgaaacctaattcttcgaaggcgtactggcccttagttcagttattttagttgtataagttgatattttttttctggaatgtagccatttgctgttatctgggaaacaagattctaacaggaaaccagcctaagacacttcaggttgagcgctgcctcggagtctgtgcccgtcgcgtcccctgcttgagttttgcacttggaagaaccctgcaccggctggcgtgtgcgacggcccagtcccatccagagcatggagcccgaccccagccagcgccttccactccatcatttcatttcacacccccgaagggaggggaggccaggaggggagctgctcctgccagaagctggtgggtgaccgttgggaatcggccacacctggtgtccatgggcagcctggtgcaattccattcatttgtacagaaacatttttgaaaaattcttttcaataagatgcaaaatcttccaacttttcaacccaacgtgatgaatatttgattttgttctagatttcctgtagctgtgaattgttaaaatgtatgattcaggataaaacgtaaacacgtgctgttagtaatttcttgtggatttcattgttttgccttcaaataaagcctttttttaaagaccttt

SEQ ID NO: 113281 - DNA, 3053 bp, Homo sapiens
  Payload ID: 2149
  Gene Symbol: CALHM1
  Gene Name: calcium homeostasis modulator 1
  Uniprot ID: Q8IU99
  ENST ID: ENST00000329905
  CDS Start-End: 138-1178
ctctgctctgagctctgttggtcccagccaggagagcccgagtcatgaggtgggcacccagtgggcagggtgggcagcaggggccctcttggaggcagcagtgagttgggaagaggaggccgggccccacagcgggcatgatggacaagttccggatgatcttccagttcctgcagtccaaccaggagtccttcatgaatggcatctgtggcatcatggccctggccagtgcccagatgtactcggccttcgacttcaactgcccctgcctgccgggctacaatgcagcctacagcgcgggcatcctgctggcgccacccctggtgctctttctgcttggcctggtcatgaacaacaacgtgtccatgctggccgaagagtggaagcggccgctgggccgccgggccaaggaccccgctgtgttgcgctacatgttctgctccatggcccagcgcgccctcatcgcgcctgtcgtctgggtggccgtcacgctactcgacggcaaatgcttcctctgtgccttctgcactgccgtgcccgtgagcgcactgggcaacggcagcctggcacccggccttcctgcccccgagctcgcccgcctgctggcccgggtgccctgccctgagatctacgatggcgactggctgttggcccgagaggtggccgtgcgttacctccgctgcatctcccaggcgctgggctggtccttcgtgctgctgaccactctgctggcattcgtggtgcgctctgtgcggccctgcttcacgcaggccgccttcctcaagagcaagtactggtcccactatatcgacatcgagcgcaagctcttcgacgagacgtgcacggagcacgccaaagcctttgccaaggtctgcatccagcagttcttcgaggccatgaaccatgacctggagctgggtcacacccacgggacactggccacggcccctgcttccgcagctgcccccacgacccccgatggtgcggaggaggaaagggagaagctgcgtggcatcacggatcaaggcaccatgaacaggctgctcacgagctggcacaaatgcaaaccgcctctgcggctgggccaggaggagccaccgctgatgggcaacggctgggctgggggtgggccccggcctccgcgtaaggaggtggccacctacttcagcaaagtgtgaggtgtggccagctgaagaggcaggaacggggatctgagcccacagcccctccaacccccaaaccaggtggaaaaaggaagggtttcagtgctgggcagtactcccctaggcagatccacactccctagcactcgcctgcccattggaggcaggaaatttggagctggaaggggatctgatgccttcaggtgtgacactgccctggatggccctagggcagtgggcccatgagcagtattagtctaaaggggtcggaactgtcatggcaggtacagggaccaatggctcccctctgcccagcccttcccaggctgatgttcactgtctcctcccaggttcaacagacatccctgccccagggtccaccctcgtctgtggctgttcagtacctctcttcctttatgctccgggctcggggagtgggaatcatcaggcgtctcatgaagtgggagccctctgatttgggcaagcgtgtcgtaggtgagactgggtgtgccggggcaggtccataaggacatgacacacagcctacctggtgtgacacacctggggtgacaggcgatgagacaagatgtcagaagctaggttcacatggaagaggtcagagtgtgtggtcaccatgggggtcatgtgacaattgtccaggtggactgcatgtttatttagcacaaaccaagcacaaaagtcctcctgtagaggggtctttgaaaaaccaccttaatacccccgtcacatccaggtctccaggggaaatcagaccatccccaaggcttgagaagttagacacagaagctgaagtctctccatttttctcaaagaccccacctcttggggatggagttctaagaggctaagaggagctccaaggctctagcccaggtgggatgagggtggaggagagcagtgtaaagagaaagcagctcagattccagagtgagacagaactgggtcaaatggtgtctctaccactcacaaaccctgtccctgggccagctgcatcactgcctgtgccttcgtttcttcatctatacaatgaggatgaggcccccccggcccgccatcatggggttgctgtgtgtaaaagcacatggcacatagtaggcacccagcacagggtggctaatgtatttgttgatttctgaacctaaggacttccttcctcctcccctgggcagggatgagacagcaacacaaacactcgagcttccatcttgttgaggaggaaacagaggtacagataggtttctcagcaccgccctcagctctgagacataagtcccaagcatctaaggattcattttgatcttggcatgattccatccttttttatccatccttccctctattcccacttctggggtccagtttccctcctcttaattatttgggaggagttgctcagatctttgtgggccaaggtgggctgggagggctcttccaggaggtaggagttggtatgggccctgaagtcagggaggattaggatgagcaaaaaacaaggtgtatgttggtgggtggcagcacttccagtgggaagagaaggcccggaggtatcaggaggtacaaatgtgatgaagagcaaagctttgggtcaggcacacctgagttcaaataccagcactgcaggacttgtggccagtcacccagccactctaagcctcagtgtgtctgtctataaaatggatattagaagacctgcttggccaggcggagtggctcatgcctgtaatcccagcacttgggaggccaaggagggaggatcacttgagcctgggagttggagaccagcctgggcaacatagcaagactctgtctctgtaaagtaataataataataagaagaagaagaagaataaagagaagatttataatttt

SEQ ID NO: 113282 - DNA, 1859 bp, Homo sapiens
  Payload ID: 2150
  Gene Symbol: CALHM2
  Gene Name: calcium homeostasis modulator 2
  Uniprot ID: Q9HA72
  ENST ID: ENST00000260743
  CDS Start-End: 525-1496
gttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggttgccagcgtcgctacagcccagaccaaggcagaataatctccggatgagctggtggcaccgctgagcctttggtctcaccagggcttcctgttgctggcaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaa

SEQ ID NO: 113283 - DNA, 1843 bp, Homo sapiens
  Payload ID: 2150
  Gene Symbol: CALHM2
  Gene Name: calcium homeostasis modulator 2
  Uniprot ID: Q9HA72
  ENST ID: ENST00000369788
  CDS Start-End: 506-1477
ctctgcctggtggcgccgggaggctgtttttccactcactggcgcgcagactccatcccactgttttcttctctcttttctggagttagattagtctgaagccgccaccagccccaggcccccgtgcagaagaaaagcgggagggaacggcggaggccgccgctgccctgcaccgccctcctggaggccacttggagagtccggccccgaggaggccatggccacaagtgcccacagctggccccaggcggggtggagcggagctgctgggaggctgctggataggagaggggtcacggctgcggaagaggaggttcttcgggacacccgtggatggacacggcaaggaaacaccaggccaaccacagctggggataaaatagcacaaccacaccctgccgtccagcgcctcccagcctgtgccccttcctagtaccaccagcaaccatcaatcccgtctcctcctgcctcctctcctgcaatccaccccgccacgactatcgccatggcagccctgatcgcagagaacttccgcttcctgtcacttttcttcaagagcaaggatgtgatgattttcaacggcctggtggcactgggcacggtgggcagccaggagctgttctctgtggtggccttccactgcccctgctcgccggcccggaactacctgtacgggctggcggccatcggcgtgcccgccctggtgctcttcatcattggcatcatcctcaacaaccacacctggaacctcgtggccgagtgccagcaccggaggaccaagaactgctccgccgcccccaccttcctccttctaagctccatcctgggacgtgcggctgtggcccctgtcacctggtctgtcatctccctgctgcgtggtgaggcttatgtctgtgctctcagtgagttcgtggacccttcctcactcacggccagggaagagcacttcccatcagcccacgccactgaaatcctggccaggttcccctgcaaggagaaccctgacaacctgtcagacttccgggaggaggtcagccgcaggctcaggtatgagtcccagctctttggatggctgctcatcggcgtggtggccatcctggtgttcctgaccaagtgcctcaagcattactgctcaccactcagctaccgccaggaggcctactgggcgcagtaccgcgccaatgaggaccagctgttccagcgcacggccgaggtgcactctcgggtgctcgctgccaacaatgtgcgccgcttctttggctttgtggcgctcaacaaggatgatgaggaactgattgccaacttcccagtggaaggcacgcagccacggccacagtggaatgccatcaccggcgtctacttgtaccgtgagaaccagggcctcccactctacagccgcctgcacaagtgggcccagggtctggcaggcaacggcgcggcccctgacaacgtggagatggccctgctcccctcctaaggaggtgcttcccatgctctttgtaaatggcactacttggtcccaaactgaaccccactgcttgctcacatccatatcagaaggggatttttaaaaaactgttatcttcttggccaggggaaaggaccacaaggcaatctggggtgtggacagacccagtagacaatggaagccccagccagcagggccaggtgacagtgaagctcaccagtgggctcctttatggtactctatgcagttaacatgtatctagctgcatagggacacccagcgcagcagtgcaccactgggaagtggcctccagtgcagcctctggccttattttatatatttaaatttttgataaagtttttcttactaaaagga

SEQ ID NO: 113284 - DNA, 1652 bp, Homo sapiens
  Payload ID: 2151
  Gene Symbol: CALHM3
  Gene Name: calcium homeostasis modulator 3
  Uniprot ID: Q86XJ0
  ENST ID: ENST00000369783
  CDS Start-End: 209-1243
gcctgtccctgccttaagtgcctactggatcccgggagcctgggctggggcctgggcactgcttcctccttggcccctcaggcccttggaagcagagagagaacctcttgcagatcccaggctcgtccccagcacagcagacaccaggaaggtggccagagcctcactgagccgaaccgacggccgcccacccacccaggctggagccatggataaattccgcatgctcttccagcacttccagtcaagctcggagtcggtgatgaatggcatctgcctgctgctggctgcggtcaccgtcaagctgtactcctcctttgacttcaactgtccctgcctggtgcactacaatgcactctacggcctgggcctgctgctgacgcccccgctcgccctgtttctctgcggcctcctcgccaaccggcagtctgtggtgatggtcgaggagtggcgccggcccgcagggcaccggaggaaggacccaggcatcatcaggtacatgtgctcctctgtgctgcagagggcgctggccgcccccctggtctggatcctgctggccctccttgacgggaagtgcttcgtgtgtgccttcagcagctctgtggaccctgagaagtttctggactttgccaacatgacccccagccaggtacagctcttcctggccaaggttccctgcaaggaggatgagctggtcagggatagccctgctcggaaggcagtgtctcgctacctgcggtgcctgtcacaggccatcggctggagcgtcaccctgctgctgatcatcgcggccttcctggcccgctgcctgaggccctgcttcgaccagacagtcttcctgcagcgcagatactggagcaactacgtggacctggagcagaagctcttcgacgagacctgctgtgagcatgcgcgggacttcgcgcaccgctgcgtgctgcacttctttgccagcatgcggagtgagctgcaggcgcgggggctgcgccggggcaatgcaggcaggagactcgagctccccgcagtgcctgagcccccagaaggcctggatagtggaagtgggaaggcccacctgcgcgcaatctccagccgggagcaggtggaccgcctcctaagcacgtggtactccagcaagccgccgctggacctggctgcatcccccgggctctgcgggggtggccttagccaccgcgcccctaccttggcactgggcacgaggctgtcacaacacaccgacgtgtagggtcctggccaggcttgaagcggcagtgttcgcaggtgaaatgccgcgctgacaaagttctggagtctttccaggccgtggggaccccacggcaggcaccctaagtcttgttagcctcctttttaaagtagcccaatctctgcctagtttctgggtgtggcctccagcgcgcttcacaaactttaatgtggactcggttcaccgagggccttgttaaatacaggttcagacagtgtagccaggaccgagtctgagattctgcattttaaacaagctcctggaggctgatgtgcttttggtcagtgaaccaaactttgagtagcaagaatctaagtaaatctgccatgggttctgggttctagatgtcaattctaaataataataatgaccttagtctgctgcctcgata

SEQ ID NO: 113285 - DNA, 2221 bp, Homo sapiens
  Payload ID: 2152
  Gene Symbol: CAMLG
  Gene Name: calcium modulating ligand
  Uniprot ID: P49069
  ENST ID: ENST00000297156
  CDS Start-End: 121-1011
gggggcgggtctatagtgggaaggggacgcgcgccctgcggcccggcctctagtcatcgccctcgcagcggcggccaacatcaccgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggaagaagaaagtcaaacaaaatcaaagcagcaggacagtgataaactgaactccctcagcgttccttccgtttcaaagcgagtagtgctgggtgattcagtcagtacaggaacaactgaccagcagggtggtgtggccgaggtaaaggggacccaactgggagacaaattggactcgttcattaaaccacctgagtgcagtagtgatgtcaaccttgagctccggcagcggaacagaggggacctgacagcggactcggtccagaggggttcccgccatggcctagagcagtacctttccagattcgaagaagcaatgaagctaaggaaacagctgattagtgaaaaacccagtcaagaggatggaaatacaacagaagaatttgactcttttcgaatatttagattggtgggatgtgctcttcttgctcttggagtcagagcttttgtttgcaaatacttgtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaattgtctaatgttaactctgcacattgtaacttttcttgttgagttagtatcttaatttttactccagcacaagtatttaatcaaagaaaagattcatacatgtgaaattggaaggtatttataaaatttttattgctgtataccaaactcagaattggaactttttacatttgagtttcactttttagaagtatgttttaagcaagcaaaaacaaaatgggatgtgaagaattgaggcatgcaacccaatagcataaatgtcctttttccccccaaatatggtctagatgagttattataaacattgtttttatttttttgagacagagtttcgctcttgttgcccaggctagagtgcaatggcgccatctcggctcaccgcaacctccaccttcctggttcaagggattctcctgcctcagcctcccaagtagctgggattacaggcatgcaccaccacgcccagctaatttttatattctttagtaaagacagggtttctccatgttggtcaggctggtctcgaacttctgacctcaggtgatctgcccacctcggcctcccaaagtgctgggattacaggcgtgagccactgcacctggccttataaatatccttttaactaactcagtaactgccatattttgttgggttgtcttcttaaaagaatataagactaaagtgttaatgtcacttggtgttacatttccttacagatttttgtatagtctaatttggttaatccttgtgacattaaaaacacatacactttttaaaaaatta

SEQ ID NO: 113286 - DNA, 895 bp, Homo sapiens
  Payload ID: 2152
  Gene Symbol: CAMLG
  Gene Name: calcium modulating ligand
  ENST ID: ENST00000514518
  CDS Start-End: 39-281
accgccactgccacccctcccagactgtggacgggaggatggagtcgatggccgtcgctaccgacggcggggagaggccgggggtcccagcgggctcaggtctgtcggcttcccagcgtcgggcggagctgcgtcggagaaagctgctcatgaactcggaacagcgcatcaaccggatcatgggctttcacaggcccgggagcggcgcggtccatatttgctccatttcttactttacaacttgcgtacatgggattatacaaatattttcccaagagtgaaaagaagataaagacaacagtactaacagctgcacttctattgtcgggaattcctgccgaagtgataaatcgatcaatggatacctatagcaaaatgggcgaagtcttcacagatctctgtgtctactttttcacttttatcttttgtcatgaactgcttgattattggggctctgaagtaccatgaagcctgtagaactgagaaggagaagcttacaaaaaaaaaaaaatcctcttctatattgcagtgtctctaaaggaggcaaattggtttacaccttcatgtaattcttttactttaggggttgtaaagctactttattagatatagaatggcagattctctgatttaaaagggctgagtttgtattattactgatatgaagaatagagtaccaatgtcattaattgatttttcttgttaatcagaattcctattctgtacctttcctctaacttctcagatttgtaattcttcttttgggagctgagctagtgcttttaggagaacagataaatgtggtctcagccagccctagagactgcttcttgtgtttgtgtcattctgtcctgagaaatgaagtcatctgaaaaataaaatgaaagaaactgaa

SEQ ID NO: 113287 - DNA, 746 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000311052
  CDS Start-End: 52-495
ctcagtcggagcgaagcggctggcggagcagaacggattgcagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaagga

SEQ ID NO: 113288 - DNA, 3026 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000396593
  CDS Start-End: 361-804
ggtgccttaggcgctggagaaaaacttcacccgcgcccacaggccccctttccgcaggctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacacgtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggcta

SEQ ID NO: 113289 - DNA, 556 bp, Homo sapiens
  Payload ID: 2153
  Gene Symbol: CARHSP1
  Gene Name: calcium regulated heat stable protein 1, 24kDa
  ENST ID: ENST00000565287
  CDS Start-End: 163-556
agtcggagcgaagcggctggcggagcagaacggattgcaggcaggccccccagtcctgggtgcaggcttgtgacagctgctcagggatccaaacgtggcgcttgagctctctgcgacgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctgg

SEQ ID NO: 113290 - DNA, 729 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000561530
  CDS Start-End: 43-486
aggccccctttccgcaggctgcgctggcggttcaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcattt

SEQ ID NO: 113291 - DNA, 565 bp, Homo sapiens
  Payload ID: 2153
  Gene Symbol: CARHSP1
  Gene Name: calcium regulated heat stable protein 1, 24kDa
  ENST ID: ENST00000567908
  CDS Start-End: 189-565
attgtcgtctaagtccccaacttctcagcagggcttcctgttatcttccgccactaccttctccagcctctctctgcctctgttctccctcccttcgggcctttggccctcctctgggctcggggtcctccttggagaccccaccgccctctgcactccctgggtggcctcggtgatgaccgtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggt

SEQ ID NO: 113292 - DNA, 598 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000567554
  CDS Start-End: 56-499
caggagttcctccttggccgcggctgtagctgagagaagggacaggaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggct

SEQ ID NO: 113293 - DNA, 461 bp, Homo sapiens
  Payload ID: 2153
  Gene Symbol: CARHSP1
  Gene Name: calcium regulated heat stable protein 1, 24kDa
  ENST ID: ENST00000568968
  CDS Start-End: 118-461
atgcgggggccctggcccccaggccagcagctggggcctttttgaggtgggggctccccggactcaggagttcctccttggccgcggctgtagctgagagaagggacaggaggtaggatgccacctcctccagaaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgag

SEQ ID NO: 113294 - DNA, 521 bp, Homo sapiens
  Payload ID: 2153
  Gene Symbol: CARHSP1
  Gene Name: calcium regulated heat stable protein 1, 24kDa
  ENST ID: ENST00000568117
  CDS Start-End: 185-521
gtggactgagcccgccgtgcgcttggcattttcgcggcaccatctgcacagcgtccgagccctgcgacgcagcaccgctcctgtcccctttgacagatgaggaaactcgggtggggcggtgaaatcgcctggcaggggtcacagagggagtggggaccagtcagggctcaatctcaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgct

SEQ ID NO: 113295 - DNA, 442 bp, Homo sapiens
  Payload ID: 2153
  Gene Symbol: CARHSP1
  Gene Name: calcium regulated heat stable protein 1, 24kDa
  ENST ID: ENST00000569398
  CDS Start-End: 230-442
gggggccctggcccccaggccagcagctggggcctttttgaggtgggggctccccggactcaggagttcctccttggccgcggctgtagctgagagaagggacaggagcaggccccccagtcctgggtgcaggcttgtgacagctgctcagggatccaaacgtggcgcttgagctctctgcgacgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgc

SEQ ID NO: 113296 - DNA, 681 bp, Homo sapiens
  Payload ID: 2153
  Gene Symbol: CARHSP1
  Gene Name: calcium regulated heat stable protein 1, 24kDa
  ENST ID: ENST00000570125
  CDS Start-End: 308-681
acttcccgcctggccacctgttctctgcgtgcaggggaagctcttcccgccctccccgctgcttttgcctttgggcgggagccctggacgggggactcgccgggcggtggggcgaggcgcggggggcgtcgcacgcgggaagcagagccaccccccgccgggcctggccgcgccagctgtggctcgaggaggcctctcggagcctcagtttccccatctgcagactgggctctgacttcttctggcatgagagggtgtgtgagagtaaaaggaggcagctagccccgtgccgggagacacgtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtgga

SEQ ID NO: 113297 - DNA, 843 bp, Homo sapiens
  Payload ID: 2153
  Gene Symbol: CARHSP1
  Gene Name: calcium regulated heat stable protein 1, 24kDa
  ENST ID: ENST00000562843
  CDS Start-End: 303-587
ctgcgctggcggttcaggtttgcaggccggaagtgaaatgttcttttttgatttttaaaaaggaagcctccggccctatggttttctggggttggagtggatgtgtgtgctgggggaggcggagacgtcccgctccaggcagggccttgggtcttaataggtggggaaatctctgccaaataggaggcctctcggagcctcagtttccccatctgcagactgggctctgacttcttctggcatgagagggtgtgtgagagtaaaaggaggcagctagccccgtgccgggagacacgtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgagtgagtcagcggcaggtctgggtggcctggctggggtgggcgcttccttggccctgtggaggtggggatggtgtgtgactctgatgggcgctgggtgtgaggacgaatggctgggcctgtgtgactctgcctgtggctggtgctccagctgtgctcctgtgtgtgtgttgggttggggttgtgagactctacggagctgtgttgggggatgtgaggctgggggcgacacggtacttgtgattgtccctgggtgtgtcttt

SEQ ID NO: 113298 - DNA, 2841 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000610831
  CDS Start-End: 177-620
attctaggactctatgacctgtgctggtaggtcatgcgggggccctggcccccaggccagcagctggggcctttttgaggtgggggctccccggactcaggagttcctccttggccgcggctgtagctgagagaagggacaggaggtaggatgccacctcctccagaaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggct

SEQ ID NO: 113299 - DNA, 2849 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000619881
  CDS Start-End: 185-628
gtggactgagcccgccgtgcgcttggcattttcgcggcaccatctgcacagcgtccgagccctgcgacgcagcaccgctcctgtcccctttgacagatgaggaaactcgggtggggcggtgaaatcgcctggcaggggtcacagagggagtggggaccagtcagggctcaatctcaggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggct

SEQ ID NO: 113300 - DNA, 2931 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000614449
  CDS Start-End: 267-710
attctaggactctatgacctgtgctggtaggtcatgcgggggccctggcccccaggccagcagctggggcctttttgaggtgggggctccccggactcaggagttcctccttggccgcggctgtagctgagagaagggacaggagcaggccccccagtcctgggtgcaggcttgtgacagctgctcagggatccaaacgtggcgcttgagctctctgcgacgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggct

SEQ ID NO: 113301 - DNA, 2833 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000611932
  CDS Start-End: 169-612
gctctcagtcggagcgaagcggctggcggagcagaacggattgcaggcaggccccccagtcctgggtgcaggcttgtgacagctgctcagggatccaaacgtggcgcttgagctctctgcgacgtgttccacagttccctggaggcggacactgcgtgagggtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggct

SEQ ID NO: 113302 - DNA, 2972 bp, Homo sapiens
  Payload ID: 2153
  Gene Symbol: CARHSP1
  Gene Name: calcium regulated heat stable protein 1, 24kDa
  Uniprot ID: Q9Y2V2
  ENST ID: ENST00000618335
  CDS Start-End: 308-751
acttcccgcctggccacctgttctctgcgtgcaggggaagctcttcccgccctccccgctgcttttgcctttgggcgggagccctggacgggggactcgccgggcggtggggcgaggcgcggggggcgtcgcacgcgggaagcagagccaccccccgccgggcctggccgcgccagctgtggctcgaggaggcctctcggagcctcagtttccccatctgcagactgggctctgacttcttctggcatgagagggtgtgtgagagtaaaaggaggcagctagccccgtgccgggagacacgtcagccatgtcatctgagcctcccccaccaccacagccccccacccatcaagcttcagtcgggctgctggacacccctcggagccgtgagcgctcaccatcccctctgcggggcaacgtggtcccaagcccactgcccactcgccggacgaggaccttctcggcgacggtgcgggcttcacagggccccgtctacaaaggagtctgcaaatgcttctgccggtccaagggccatggcttcattactccagctgatggcggccccgacatcttcctgcacatctctgatgtggaaggggagtatgtcccagtggaaggcgacgaggtcacctataaaatgtgctccatcccacccaagaatgagaagctgcaggccgtggaggtcgtcatcactcacctggcaccaggcaccaagcatgagacctggtctggacatgtcatcagctcctaggagatggtggaagcaccccttgtcctgtgcttgtgggagactttgcagggaggaggcagcagacactggagatgacattcttccacacgagacggggcttcagccgggcatggtccctctcaagtatctcctggaggaaggggtatggggggcaggtgtggggtgtggggtgttcccggccatcagcacagcctatgaccattgcaacaacctctcaccatctgaagagcattaaaagcatttaaaaaggagaggtgcccactggtggctgagtggaggttccaaccccatcccagggagtggatcaagggtggtatttctccagctgctcagacacatgggctcaacccacagaatccctcttcctcctggagctggaggccccagattcccagatctggccccctggcagcctgacagggaccttgcgtgacttctccaaggcaaatttccacctaagtgccccttgcgcctctcctggggcctgggcaaagcagttttctaattcttggcttggttggttctaggggagctggcttgaagtgggtggggaaaggcgggggtggcggtctttggattggacggatgttgccttttggtgcctttgcagtgggaggcggcatagctgcctgtctggggaagacagttctcccagcactcccacccctgggcacagcaggctggtactgggaggctgaacccctcttagagcctgaccttttcatctgccttctggttgtgtgaccatcactcaacagccatttcacagcccctgtaattatggcggcggggggctggggtggtggtggtgggaagggcttgtggagaggacacagtctttgtttaaaaactttgtcccgatccatccagaaaagagtaggtagcttgcatcctgacagcctggcaaagtcaagaaagttgaaggagaaacatacctttggagagggggttttctttaaaactagtgttaagaaatgcttagggattttttttttcttatttttcataactaaagctttcacccagagccggctctgtttgcactttgctgccgacattgcaaactttttggcagggtgggagactgagtctcattctgtcacccaggctggagtgcagtggcccgatctcagcttactgcaacctctgccctccagggttctggcaattccgcctcagtctcctgagtagctgggattacaggcatgcgccaccacacccggttaatttttgtatttttagtagagaccaggtttcatcatgttgggcaggatggtcttgaacccctgacctcagatgatctgcccatctcggcctctcaaagtgctgggattacaagtgtgagccatcgcgcccggcctgcaaacttttttgtaggtatttctggtaaacaaatccttaggttatctttgctgtggttgtggtttggctttagtcatgatttcaaagtagaaatagctaggcattattttttgaaatatatgacctatatgtagtcaagaatccactgaacagaggcaagcaaaccttttggaaactggcttttgggcagacagtaaacgtccagtttgatgctggaagcatgaacagcttcatcaggtaggtactcctcaactctgatgagtttgtcctttcagcctaagggggtggaagggagttgtttgagaatagcaaatacgcatgttgattgcgagtgtgtggagacaaaggcagttcccaccacagttaggtcctggccattgtttcctcgcctgcgatgctccttgtacatcctcaccctcctctcccgcctctgccttctgctgggtcaaaggtggccttttctctccagccttgaattgttccctgttggcttcccaagggcccatctgctggtacagtccacacttccacagccaagacccgagagggctttcactgccccaagcctctctcctgtgaccctgggattctgtcttggcagaatcctttgtcagcggctcttactctgtccttcctgtttggccacagctctttcaatcaatgggtattctagaaccgcaggatgtcagagctggaagggacgcgataccggtttacacaaggggaaactcctcgaggctctgggagggacggagggttttggtgacagagcgagagctaaaattgaggattcctgaatccagatcttgcctcccatcagccatctttctcccaataaatttttgttttgtgcaaggct

SEQ ID NO: 113303 - DNA, 2186 bp, Homo sapiens
  Payload ID: 2154
  Gene Symbol: CRACR2A
  Gene Name: calcium release activated channel regulator 2A
  Uniprot ID: Q9BSW2
  ENST ID: ENST00000252322
  CDS Start-End: 470-1657
gtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtggaattcaagtcaccagtggccaaagtaccctccaggtgtgaagagttgcaggtcctccgaggagccgggagctgcaaggttctgaaaaagacttcaagaaactgactaatcgcgatggctgcccctgacgggagggtagtctccagaccccagagacttggtcaggggtctggccaggggccaaaggggagtggagcctgcctgcatcccctggacagcctggagcagaaggagactcaggagcaaacgtcgggccagctagtcatgctgaggaaggcacaggagttctttcagacctgtgatgctgaaggcaagggcttcatcgccaggaaggatatgcagaggctgcataaggagctaccgctcagcctggaggaactggaggatgtgtttgatgccctggatgctgatggcaatggctatctgaccccacaggagttcactactggatttagtcacttcttcttcagccagaataacccaagtcaggaagatgcaggtgaacaggtggcccagcgccatgaagagaaggtgtatctgtccagaggggatgaggatctgggcgacatgggcgaagatgaggaagcccagttccggatgctgatggacagacttggagcccaaaaggtgttggaagatgaaagtgatgtcaagcagctctggttgcagctgaagaaggaggaacctcatttactgtccaactttgaagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaaggtgcgtcggtgggcactggcctgtgctgagagcacctcccagaagcctggggtcggaaggaccagtctgagggtcatccttgcctacgtgctggaaaaacgtgcctgctgagagagtgccctcaattcccttggtccccagtgcagtgtttggaccaccaagtagccactctattatgtttggtccgtttacacatgcgcccacatccagtttattcctcctggtggggaggctctgccccactcctctgagtccctcacaggactgtgcttggtacttgatctcatgcgagcagagctgggtttaatgagcatttaatctatgctagaaatattatctcgttcattgtcagcaaaactgttaggtgagtagggcagttcattcacaggaatttactgatgggaagttgatattagaggaaagaagtaatttaccacaggcgacacagctactctctgatggggccagaatggaaatccgtaactcggctgtgttctgttcatgtttgttgaatgagtaaatgaatcacaaacagagcaccaagaaaaagctttctcagccttcaaagacccccagcaataaactcaaagtttactggt

SEQ ID NO: 113304 - DNA, 3207 bp, Homo sapiens
  Payload ID: 2154
  Gene Symbol: CRACR2A
  Gene Name: calcium release activated channel regulator 2A
  ENST ID: ENST00000333750
  CDS Start-End: 1-596
aagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaaggtgcgtcggtgggcactggcctgtgctgagagcacctcccagaagcctggggtcggaaggaccagtctgagggtcatccttgcctacgtgctggaaaaacgtgcctgctgagagagtgccctcaattcccttggtccccagtgcagtgtttggaccaccaagtagccactctattatgtttgggaaaggaacaagcaccttcgggatgaacgggacatatgttttcagaaaaataaggcagccaaggcaaacacagctgcttccagggcaagttggaaaaagagatctggctctgtgataggcaaatatgtggacagcagagggattcttaggagtagccagtcagaggaggaggaggaggtgtttggcatcccaaggagaagctccctgggcctgagtggatatcccctaacagaagaggagccaggaaccggggagccagggcctgggggtccgtacccccggccgctccgcagaatcatctccgttgaagaagaccccctgccccagctcctggatggtggctttgagcaacccctgagcaaatgctcagaagaggaagaggtctctgaccagggggtacagggacaaatcccggaggccccacccttgaaactcacccccacatccccccgagggcagcctgttggaaaagaagccctgtgtaaggaggaaagctctccctctgcccctgaccggctcttcaagattgtgttcgtgggcaattccgcggtggggaagacatccttcctgaggagattctgtgaggaccggttctccccaggcatggcggccactgtgggcattgattaccgtgtgaagacgttgaatgtggacaactctcaggtggccctgcagctgtgggacacggctgggcaggagaggtaccggtgcatcacccagcagttcttcagaaaggcagatggtgtcatcgtcatgtacgatctcacagacaagcagtcgttcctgtcggtccggcggtggctgagcagcgtggaggaagctgtgggagaccgggtgcctgttcttctgctgggtaataagcttgacaacgagaaggagcgggaagtcccccggggcctcggagagcagcttgccacggagaacaatctgatcttctatgaatgcagcgcctactctggtcacaacaccaaagagtccctgctccatctggccaggttcctcaaggagcaagaagacacagtgagagaggacaccattcaggtcggccaccctgctaagaagaaatcctgctgtggctgatagggtcctacaaggactgcccccagcaaacctgaggtcacagagcctgccctgatcctgcacacggctcctgcacagatgccacccaccggggcccgcccagtccttttctttgtcagtcactcacctcccccaaaaggaagggaagcacatcccatcaggagagctgctcttggagcatctcagagtcttttctctcctttctctttctagaccccagatgcctgtccctgctttgttgttgttgttgttttccccgacttagtttcctaggggaaagaaacagatgggcttttccagaaaagccaccacgtgccttctccacgcccccttctcctccccttgcccttaggagcctcagcactgctgttgccgtgacaactatgcagggctcgacttgcggcttcctgcaggccaaagacagtgtggtgcccaacaaagcatccgtctcaacaccccgcggcctccccagctgccactagtagcaatccattacccacaggcagctcaacaactcaatgtgacttgggctccacgcctctacacaaaagatgcttccctgccctgttctcctccttcctgttgtgaaagcagcctcccttgcccttacccagctgtggctctctcagcggcttcctctagccccaaaggcctgctcagaataaggacctgcacacaagttgtgtggccctgggcaaaacctggagctgcttgatgttctgagcctgctttcaaatctgcaaaatagtgctctctgccttactccctcgcaggctcgtgtgaaggtcaaaagagaactcctgggaaagagcttagtcagctgaaaggctctaaacaaatgatagttattacatcgtcctctgtctccccatgcaagagaccagaacaaaacaatatacaaaagagagagaaaatcccacacctcttggtaactggaaaggctgaggccatgggtgagagcacctcccatttccctgggaaaggagaataagtaaaacttgaattccttcaattagagactcatctaagaatcctttctatcttcccactctgttttgaagtaggacagggggcccagcatcacagacgacaaggttcttaccttgtagttctggtctcatttgtttctgtatttatcaagcctggtacataaacacagtaggtaggtggatggatgaatttgctgtccggtcaagacttcagctagcacattcctaattgacctgcctttacatatatggtttctaaaacactttcacactgggatgatgacagagttctggagatggatggtggtgatggttgcacacactattgggaatatacttaatgacgttgaattgtacatttttaaatggttaaaattgtaaattttatggtatgtatattttaccacaataaaaaattttaagaagaaa

SEQ ID NO: 113305 - DNA, 2697 bp, Homo sapiens
  Payload ID: 2154
  Gene Symbol: CRACR2A
  Gene Name: calcium release activated channel regulator 2A
  Uniprot ID: Q9BSW2
  ENST ID: ENST00000440314
  CDS Start-End: 475-2670
aaagagtcgggcggagcaggcggctgcttgacagctgagagccgagcgggcggcgcgggcaggtccacgggaagcctacacgcccaaggtcatgccctgaccacagctgcccttcaggaggctggcacggagccacctggggccattgggctgtttgtcaagggtggggcagcagcaacttgccactcttcctccatgagcccagccagagcctccactgggcacttagcacaagaaaaaccctgcaggagccggatccagagcgctgggattcagcaggagtgccaggagaattcaacacaggtgtgctgcctcctctcctgccaggtgtgtggctgcacaggagtcttgctgatggtggaattcaagtcaccagtggccaaagtaccctccaggtgtgaagagttgcaggtcctccgaggagccgggagctgcaaggttctgaaaaagacttcaagaaactgactaatcgcgatggctgcccctgacgggagggtagtctccagaccccagagacttggtcaggggtctggccaggggccaaaggggagtggagcctgcctgcatcccctggacagcctggagcagaaggagactcaggagcaaacgtcgggccagctagtcatgctgaggaaggcacaggagttctttcagacctgtgatgctgaaggcaagggcttcatcgccaggaaggatatgcagaggctgcataaggagctaccgctcagcctggaggaactggaggatgtgtttgatgccctggatgctgatggcaatggctatctgaccccacaggagttcactactggatttagtcacttcttcttcagccagaataacccaagtcaggaagatgcaggtgaacaggtggcccagcgccatgaagagaaggtgtatctgtccagaggggatgaggatctgggcgacatgggcgaagatgaggaagcccagttccggatgctgatggacagacttggagcccaaaaggtgttggaagatgaaagtgatgtcaagcagctctggttgcagctgaagaaggaggaacctcatttactgtccaactttgaagacttcctgaccagaatcatctcccagctccaagaagcccatgaggagaagaatgaactggagtgtgccctaaaaaggaaaattgctgcttatgatgaagaaatccagcatctctatgaggagatggaacaacaaatcaaaagtgagaaggagcagtttctcctgaaggacacagagaggtttcaagcccgcagtcaagagctggagcagaaactgttatgtaaggagcaggagctggagcagctcacccagaagcagaaaaggctggaaggtcagtgcacagccctgcatcatgacaagcatgagaccaaggctgagaataccaagctgaaactcactaaccaggagctggcccgggagctggagcggacttcctgggagctccaggatgctcagcagcagttggaaagcctccagcaagaggcctgcaaactccaccaagagaaggagatggaagtgtaccgtgtgacggagagtctacagcgtgagaaggccgggctcctcaagcagctggatttcctaagggaaaggaacaagcaccttcgggatgaacgggacatatgttttcagaaaaataaggcagccaaggcaaacacagctgcttccagggcaagttggaaaaagagatctggctctgtgataggcaaatatgtggacagcagagggattcttaggagccagtcagaggaggaggaggaggtgtttggcatcccaaggagaagctccctgggcctgagtggatatcccctaacagaagaggagccaggaaccggggagccagggcctgggggtccgtacccccggccgctccgcagaatcatctccgttgaagaagaccccctgccccagctcctggatggtggctttgagcaacccctgagcaaatgctcagaagaggaagaggtctctgaccagggggtacagggacaaatcccggaggccccacccttgaaactcacccccacatccccccgagggcagcctgttggaaaagaagccctgtgtaaggaggaaagctctccctctgcccctgaccggctcttcaagattgtgttcgtgggcaattccgcggtggggaagacatccttcctgaggagattctgtgaggaccggttctccccaggcatggcggccactgtgggcattgattaccgtgtgaagacgttgaatgtggacaactctcaggtggccctgcagctgtgggacacggctgggcaggagaggtaccggtgcatcacccagcagttcttcagaaaggcagatggtgtcatcgtcatgtacgatctcacagacaagcagtcgttcctgtcggtccggcggtggctgagcagcgtggaggaagctgtgggagaccgggtgcctgttcttctgctgggtaataagcttgacaacgagaaggagcgggaagtcccccggggcctcggagagcagcttgccacggagaacaatctgatcttctatgaatgcagcgcctactctggtcacaacaccaaagagtccctgctccatctggccaggttcctcaaggagcaagaagacacagtgagagaggacaccattcaggtcggccaccctgctaagaagaaatcctgctgtggctgatagggtcctacaaggactgcccccagc

SEQ ID NO: 113306 - DNA, 630 bp, Homo sapiens
  Payload ID: 2154
  Gene Symbol: CRACR2A
  Gene Name: calcium release activated channel regulator 2A
  ENST ID: ENST00000535292
  CDS Start-End: 1-355
agagaaggagatggaagtgtaccgtgtgacggagagtctacagcgtgagaaggccgggctcctcaagcagctggatttcctaagggaaaggaacaagcaccttcgggatgaacgggacatatgttttcagaaaaataaggcagccaaggcaaacacagctgcttccagggcaagttggaaaaagagatctggctctgtgataggcaaatatgtggacagcagagggattcttaggagatggccacagagagatagaggcatcccgactcttcagtatcagacccagagagaccttgaagactgcaagcatgaaatgaaaaagatatgcaaagcggaagtgactctggagatgtaaatcagctcatcagtaaaacctttgggcctgatcatcatgaattcttgttctaaatagctgaataatgagatacaatttgggagccaaatctctgcaatagtggttggcctgttggttcctcagaatggaatggattgattgattgattcagcagacgtttactgattacctactgtgtaccagacattcttttgagttctgtaaagcctccaaaaataaattagacatgaggtcctaccattaatctccattattaaatgctcacttaataaata

SEQ ID NO: 113307 - DNA, 1663 bp, Homo sapiens
  Payload ID: 2155
  Gene Symbol: CRACR2B
  Gene Name: calcium release activated channel regulator 2B
  Uniprot ID: Q8N4Y2
  ENST ID: ENST00000450448
  CDS Start-End: 349-1233
gtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcaagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagagccgcgagcaggacctggaacgcgcgggcctgcggcagcgggagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagtgggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgcactgcg

SEQ ID NO: 113308 - DNA, 1792 bp, Homo sapiens
  Payload ID: 2155
  Gene Symbol: CRACR2B
  Gene Name: calcium release activated channel regulator 2B
  Uniprot ID: Q8N4Y2
  ENST ID: ENST00000528542
  CDS Start-End: 483-1367
ggacctcaggtctagccggcaagccggagggcgggcgagacaacaacgtggcctggaggcaatggccctggcctctcgtgtccccttctctcacccgcccagacttgccctctttggaggtcgcccgggctaaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcaagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagagccgcgagcaggacctggaacgcgcgggcctgcggcagcgggagagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagtgggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgca

SEQ ID NO: 113309 - DNA, 824 bp, Homo sapiens
  Payload ID: 2155
  Gene Symbol: CRACR2B
  Gene Name: calcium release activated channel regulator 2B
  ENST ID: ENST00000527089
  CDS Start-End: 561-824
ggcggggcgcgcccagtgtttccgggaggagcggcccgggcgcgcggcaggtgcggcggcgcaactcgcgggtaggcgaccgctggtcccgccgctgaggcccctccactgccgcccgcccggcaccccctccgggccgccgtggcccgcgccaaacctgagcgtctcggtcgggaactccggttaccccctcggggcgcaaggcggcaggggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttc

SEQ ID NO: 113310 - DNA, 742 bp, Homo sapiens
  Payload ID: 2155
  Gene Symbol: CRACR2B
  Gene Name: calcium release activated channel regulator 2B
  ENST ID: ENST00000533803
  CDS Start-End: 500-742
ataagcccagccttttgtggttcagctgggtcgcacgctggatcccaggccccttccttgaaaagcagaggccttgtaccccccagggttgccgggcgggacagtgattccagcccttcagctttcaggaccccaccttccttatcaccaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggc

SEQ ID NO: 113311 - DNA, 575 bp, Homo sapiens
  Payload ID: 2155
  Gene Symbol: CRACR2B
  Gene Name: calcium release activated channel regulator 2B
  ENST ID: ENST00000528315
  CDS Start-End: 472-575
ctataagcccagccttttgtggttcagctgggtcgcacgctggatcccaggccccttccttgaaaagcagaggccttgtaccccccagggttgccgggcgggacagtgattccagcccttcaggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctga

SEQ ID NO: 113312 - DNA, 1578 bp, Homo sapiens
  Payload ID: 2155
  Gene Symbol: CRACR2B
  Gene Name: calcium release activated channel regulator 2B
  Uniprot ID: Q8N4Y2
  ENST ID: ENST00000525077
  CDS Start-End: 102-1301
cttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgacctgcagggtctccagagcgacctgcccctcacgccagagcagctggaggctgtgtttgaaagtctggaccgggctcacactggcttcctcaccgccagggagttctgcctgggcctggggatgtttgtgggggtggcgtcagcccagggagcgaacccctgcaggactcccgaggagacctttgagtcgggcgggctcgacgtgcagggcacggcgggctctctggatgaggaggaggaagaggaggagcgattccacactgtgctggagcagctgggggtggccccggtcctgggcaagcagcgggctgtgaggacgctctgggccaggctgcagcgcgagcgccccgagctgctgggctctttcgaggatgttctgatacgcgcgtcggcctgcctggaggaggcggcccgggagcgcgacggcctggagcaggcgctgcggaggcgcgagagcgagcacgagagggaggtgcgcgctctgtacgaggagacggagcagcttcgggagcagagccggcgcccgccgagtcagaacttcgcccgcggggagcggagaagccgtctggagctggagctgcagagccgcgagcaggacctggaacgcgcgggcctgcggcagcgggagttagagcagcagctgcacgcccaggctgcggagcacctggaggcacaggcccagaactcccagctgtggcgggcgcacgaggcgctgcgaacgcagctggagggggcgcaggagcagatccgcaggctggagagcgaagcacgaggccgccaggagcaaacccaacgagacgtggtcgccgtctccaggaacatgcagaaagagaaagtcagcctgctacggcaactggagctgctcagggagctgaatacacggctgcgggatgacagggacgcctgcgaggccaggcgggcgggcagcagctgcaggaaggctctgacaacagcccgcctgcctgggcccacctgctgctgctgctgttgctgggctcggccccccagacgcggctctggccaccttcccagtgcccggtgaccagccccgagtgactcacggaccatgagctagaagctgcccttgcaggaggcttgtcatgggtcgggggtgcccactcaggatgcaggctctccccagtgggccccaggctcgcctgactgaagacatgaaggacctagcctaggagtggtcagggtcccgggagtggccagggtcccgtgtgtgccctctgccagtcttcgctctgtccccgttcaatcaaccccatctcagttcagcagaaaaccccctcgtcaaataaaacccactgactgca

SEQ ID NO: 113313 - DNA, 530 bp, Homo sapiens
  Payload ID: 2155
  Gene Symbol: CRACR2B
  Gene Name: calcium release activated channel regulator 2B
  ENST ID: ENST00000530183
  CDS Start-End: 372-530
aggtgcggcggcgcaactcgcgggtcttctccactggcccctgagattgccatcacctccagctcctcctctcctgaagttggcagcccctcctgggttccagcctcctgagatgccagacccactggggcagtacccacaggccctgagcctacatcaaccaccccagtgacaccccaagcctgcagcattttccacccccagccccctggtcccaccttgccttccgcccaccttcccacctgctgcagggagggccctcggctgagccttcagacacacttgcaccccatccgctcccctcctgaatttcttctgaccctcccttggcttcacagcacctgaaggccaggctgaggccccctgctctcatggccagccctggaaagcctggggctgatgaggcccaggaggaggagggggaactcgaggggggctctgcagggccgcgggctgcaatactggagcaggctgaggagctgtttctgctgtgtgacaaggaggctaagggcttcatcaccaagcacgac

SEQ ID NO: 113314 - DNA, 5209 bp, Homo sapiens
  Payload ID: 2156
  Gene Symbol: CARF
  Gene Name: calcium responsive transcription factor
  Uniprot ID: Q8N187
  ENST ID: ENST00000320443
  CDS Start-End: 399-2348
gtggccgatagtggtcctactgtcgtgggactgctctgcgcgctcccggtggggcgcgcctgcgcattatgctggtctccatggcggggcctcggagccaagacgaggcattcgcttcaagagacaagcagtttagaatcaggcagaactggattgcaaaatttatgggcagaccggtatgtgtgcagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaaaaaaaaaaagattggtaaactagaaatatcaactataattgtcaggaaattaacctaaaggcttttgtttctccagagaccatttgtgggtatattttatattttaaaaataaagattttaaatggatatcaatgtttaatattcaaaacatgcacaatataatatcaaatttaaccttaatactttacatgaatatgagtcacttttggcttttctaagtccagcctcccattcttaattgacttggtttcaggtacatgacatgtatctaaatataaagtactgttatagtagaggtaggtggaattctaatattccctgctctttagatttatattttatttaatataaagtttattatttataccctttttaatgcaaagctaatatttagttatatgtatgatttttaataaaaattactttactttttcctatgaatttaaaacatttgatgttggcattttatacaggcaggttgccaaatttaattatgttacactaagttaaacacagcacttaattacctcaaatccagatttctcttaatctgtgtgtacataaaaggaataagtccaaattaatttatagtttagtgttgcactataggtaatattcttttgttatttctagtttttatggaatccttttctttcaagattctaaataataaatcgttacgtctcaatagtggtaatagtggtaatggtttattattagctgtttcaccaattgaactacattcttttggagacattcctttcttttttgatgttgatttgcaaaggagaaatgcttgttaatatacaaactctagtcagttacctgtgaggatgagatgtgtcagaggactcagactttggtatagttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttctaaaattttcagtatctatattggctttctctaacagctctacagcaaagtttgacatgttttttgtgtgtgtcatgtattgtaagttgtaatatctgtaggagtgagttggacattctaaattagcagtaaaaaattcacaattaca

SEQ ID NO: 113315 - DNA, 5938 bp, Homo sapiens
  Payload ID: 2156
  Gene Symbol: CARF
  Gene Name: calcium responsive transcription factor
  Uniprot ID: Q8N187
  ENST ID: ENST00000402905
  CDS Start-End: 322-2499
gacggtggccgatagtggtcctactgtcgtgggactgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatctgtggaaactgtgcagttgcattttagcctcttcccttccaatttttgtacttttaactacaaaccagtagtatactaatggttatctaatagaaatttaaagtgtcttggtaagtactgagaatttttacttgaattaatcagataagcaacagaaatcaacatatgtagcatggatttgtgctatattggaagtaaaacactataggcagaaagatgtagaaattaagagaattgaaaaagaataatagaattccttggtgtttacagataatttggaaaactttttgatgacagcagaggattttttcccccttattttgtaatgaagatccagcactggttaaaaaataatttgatttgtagttacatttttctatgccagagctcttactgaattgatgatattaggatttctagtattttaaggtaagtatttatagtttaaaatttagtttatatttaaaactttaaaacatctgatctgggatttttttgttaagtaagtatattaacttcaaataccaaattactactaagcagtatattgattataagcatctgttgtctaaagattggtactaggctggacatggtggctcacacctgtaatcacaatactttgggaggctgaggtgggtagataacctgaggtcaggagttcgagaccagcctggccaacgtggtgaaaccctgtttctactaaaaatacaaaaattagctgggtgtggtggtgggcacctgtaatcccagctacttgggaggctaaggcaggagaatcgcttgaacaccggaggcggaggttgcaatgagccgagatcgcgccattgcactccagcctgggtgacaagagaaaaactccatctcaaaaaaaaaaaaaagattggtaaactagaaatatcaactataattgtcaggaaattaacctaaaggcttttgtttctccagagaccatttgtgggtatattttatattttaaaaataaagattttaaatggatatcaatgtttaatattcaaaacatgcacaatataatatcaaatttaaccttaatactttacatgaatatgagtcacttttggcttttctaagtccagcctcccattcttaattgacttggtttcaggtacatgacatgtatctaaatataaagtactgttatagtagaggtaggtggaattctaatattccctgctctttagatttatattttatttaatataaagtttattatttataccctttttaatgcaaagctaatatttagttatatgtatgatttttaataaaaattactttactttttcctatgaatttaaaacatttgatgttggcattttatacaggcaggttgccaaatttaattatgttacactaagttaaacacagcacttaattacctcaaatccagatttctcttaatctgtgtgtacataaaaggaataagtccaaattaatttatagtttagtgttgcactataggtaatattcttttgttatttctagtttttatggaatccttttctttcaagattctaaataataaatcgttacgtctcaatagtggtaatagtggtaatggtttattattagctgtttcaccaattgaactacattcttttggagacattcctttcttttttgatgttgatttgcaaaggagaaatgcttgttaatatacaaactctagtcagttacctgtgaggatgagatgtgtcagaggactcagactttggtatagttagaaaaataatatttttctcacttgattctgtgtgaatgtctcttctgatactgttttttaatcagaaagttacagagcaactttcccacaaacaaaccaataaaacaaaaccccacaaaaaccaagagcatgaagaaaagtttaaatccctaattatatactcttttggtttttaggtagaaactggagctatcaatattttcatgtaagtatttcaaggagtagctctttaaaaatggtttctaaattagattttaaaaattcattgtcatctaaatgcatgtttagtcacaatgtatcagtattgtgtttaaaggtgctcagcatcactttttgaaaactatgtttacatatttaaaatgtttaattattttgaaatgtatagggtattaaatacaagcttctaaaattttcagtatctatattggctttctctaacagctctacagcaaagtttgacatgttttttgtgtgtgtcatgtattgtaagttgtaatatctgtaggagtgagttggacattctaaattagcagtaaaaaattcacaattacagctcagcttgtttattcattatagtttccacatttccaacttccaagtgaactttatatatactacagtgaattatagataaatacagccatggtggacctttccctcaatagtgattttttgtacaaacagttagtataattaaaaggaaaagcttttatattttatgcaaggtaaatgtttcctaaatgtcacaaaagtgatagaaaacatagcttttgggatctggtcctgcattagagtttctaattctgagacccaccagcttgtgtttcatcttctttatatcctgtcagaatacatacttaatcatgtgggtatgagaaagatgttgtttaacttgtaccaggtttaaaaaaagaggtttaaaaaatgtctgtgcgtatatatatatatatatatatatatatatatatatatatagcaacttgatgtatagtgtccttgttaccatgtatttttttcattaaaaatcctgctttttttttatacttgttagttttctttttatatttttcttagagatagtggcaattttgttcatcttgaagatgctgaataaacacttgaatacccga

SEQ ID NO: 113316 - DNA, 597 bp, Homo sapiens
  Payload ID: 2156
  Gene Symbol: CARF
  Gene Name: calcium responsive transcription factor
  ENST ID: ENST00000443740
  CDS Start-End: 312-597
attatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgg

SEQ ID NO: 113317 - DNA, 726 bp, Homo sapiens
  Payload ID: 2156
  Gene Symbol: CARF
  Gene Name: calcium responsive transcription factor
  ENST ID: ENST00000414857
  CDS Start-End: 332-726
gcgcctgcgcattatgctggtctccatggcggggcctcggagccaagacgaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctca

SEQ ID NO: 113318 - DNA, 1592 bp, Homo sapiens
  Payload ID: 2156
  Gene Symbol: CARF
  Gene Name: calcium responsive transcription factor
  ENST ID: ENST00000422368
  CDS Start-End: 228-1487
ctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagcccatcatatttcatataatattaattgatacttttggaagcaatgtaacatgatgtttacgcacataacctgggtataggcccaagctctcttatttactagaaaatttgtggaaagggaact

SEQ ID NO: 113319 - DNA, 537 bp, Homo sapiens
  Payload ID: 2156
  Gene Symbol: CARF
  Gene Name: calcium responsive transcription factor
  ENST ID: ENST00000430899
  CDS Start-End: 474-537
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgaggctggagtgcagtgctatgatcacagctgactgcagtcttaacctcccaggatcaagtgatcctcccacctcagccatctgattacctgggactgcagctattaaataatagaagaaaatggaattgaatatgatgtcagcatggaacaatctaatgattcattaagagtcaaccataatgacggtgaagagtcaaaaaccagtg

SEQ ID NO: 113320 - DNA, 572 bp, Homo sapiens
  Payload ID: 2156
  Gene Symbol: CARF
  Gene Name: calcium responsive transcription factor
  ENST ID: ENST00000447539
  CDS Start-End: 333-572
ttatgctggtctccatggcggggcctcggagccaagacgaggcattcgcttcaagagacaagcagtttagaatcaggcagaactggattgcaaaatttatgggcagaccggtatgtgtgcagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaact

SEQ ID NO: 113321 - DNA, 594 bp, Homo sapiens
  Payload ID: 2156
  Gene Symbol: CARF
  Gene Name: calcium responsive transcription factor
  ENST ID: ENST00000431787
  CDS Start-End: 317-594
actgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagaagttttatcatttgatagtctgtgatccatttcaagttgatttgctatctggtgtgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagac

SEQ ID NO: 113322 - DNA, 2513 bp, Homo sapiens
  Payload ID: 2156
  Gene Symbol: CARF
  Gene Name: calcium responsive transcription factor
  Uniprot ID: Q8N187
  ENST ID: ENST00000428585
  CDS Start-End: 253-2202
attatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttg

SEQ ID NO: 113323 - DNA, 572 bp, Homo sapiens
  Payload ID: 2156
  Gene Symbol: CARF
  Gene Name: calcium responsive transcription factor
  ENST ID: ENST00000441569
  CDS Start-End: 355-572
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggctggagtgcagtgctatgatcacagctgactgcagtcttaacctcccaggatcaagtgatcctcccacctcagccatctgattacctgggactgcagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactct

SEQ ID NO: 113324 - DNA, 460 bp, Homo sapiens
  Payload ID: 2156
  Gene Symbol: CARF
  Gene Name: calcium responsive transcription factor
  ENST ID: ENST00000445120
  CDS Start-End: 345-460
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagcatctaatctgtatggactccagggattcttcctttggacaaaatgattctcctacagttttgcccatcactactcgtgaagcaaataattcactcatatcacagaatataccagggcccctgactca

SEQ ID NO: 113325 - DNA, 943 bp, Homo sapiens
  Payload ID: 2156
  Gene Symbol: CARF
  Gene Name: calcium responsive transcription factor
  ENST ID: ENST00000427712
  CDS Start-End: 384-485
gtctccatggcggggcctcggagccaagacgaggcattcgcttcaagagacaagcagtttagaatcaggcagaactggattgcaaaatttatgggcagaccggtatgtgtgcagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggc

SEQ ID NO: 113326 - DNA, 595 bp, Homo sapiens
  Payload ID: 2156
  Gene Symbol: CARF
  Gene Name: calcium responsive transcription factor
  ENST ID: ENST00000432024
  CDS Start-End: 376-595
gcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactcttt

SEQ ID NO: 113327 - DNA, 575 bp, Homo sapiens
  Payload ID: 2156
  Gene Symbol: CARF
  Gene Name: calcium responsive transcription factor
  ENST ID: ENST00000414490
  CDS Start-End: 413-575
ggactgctctgcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagacggagtcttgccctgttgcccaggctagagtgccaaggcacgatcttggcttactgcaacctccacttcccagattcaagcagttttcgtgccttagtcacttgaggagctctggttacagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaa

SEQ ID NO: 113328 - DNA, 3574 bp, Homo sapiens
  Payload ID: 2156
  Gene Symbol: CARF
  Gene Name: calcium responsive transcription factor
  Uniprot ID: Q8N187
  ENST ID: ENST00000438828
  CDS Start-End: 832-3009
cttttcggggtcccacatggcacggcttccgacccccggcccgggacggggctcgcaggccccagaggggcaggctggagaaggaggaggttaggtgtcttcaggagggttgctgagcccaaggacgcgccatcgccgcggagaaggagccggaccccttgggcggagcgcccaatgtgtggtccctcacgccgtcccgcaccttgctttttagggttctttttccgctttctgagcccttttataccttacgtttagaaggggaaaatcatcctcccacaccttctccccgactttttgccttttttgtcttgaagttacccaaaggcctgtgtattgttctcaatggtcccaagaattactctaatatagttgtttttctgagggaggatggatggagataactatcctgatcccaatgtcactttttaaggcattcgcttcaagagacaagcagtttagaatcaggcagaactggattgcaaaatttatgggcagaccgagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcagaatttacaactctggtgacttctgatgtcttagaaaggaaggtgaatatagtcaaagcgtggcattgagataattggactgaagaccagtttgatgagaagcttttatttaaaactgatatatttgttgccagttccatatttttaccttccttaagagatgttttactcttcttattttgtataatttttatgctctttgattatctaataaggccagtatttcaaaagctgttctgaatttatccacagtaatatagtctgaacacaaatagtttacttaacttatccttggaaatattcaattttggttattacaaaacagaaaagaacaacagcaacaaaaacattgtgtgaatgtatgtttgtatgtgtgtatgtatatcatgaattttttttttaagttctgaaaaagaacttgttctctccttaaagttgtgaagaaattgttaattgccagacaggtaagaaaatgtttataatctatctcattaagaaagatgaagtattagattttacatcataacacaaagtccagcagctacatc

SEQ ID NO: 113329 - DNA, 1136 bp, Homo sapiens
  Payload ID: 2156
  Gene Symbol: CARF
  Gene Name: calcium responsive transcription factor
  ENST ID: ENST00000457031
  CDS Start-End: 219-788
atgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttg

SEQ ID NO: 113330 - DNA, 1955 bp, Homo sapiens
  Payload ID: 2156
  Gene Symbol: CARF
  Gene Name: calcium responsive transcription factor
  Uniprot ID: Q8N187
  ENST ID: ENST00000434998
  CDS Start-End: 323-946
ctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaaggtttaatatatctttgccaagtccaagggtacaaagattttctcctgtgttttcttctagaagttttatcatttgatagtctgtgatccatttcaagttgatttgctatctggtgtgagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcaggtacttttttaaagaattattttaaaaggttcagcagcagccatagtccattgtcaaaatgtgattttcctaaggtgataacatttttattttggtagctgacaattgaatgctaattgattaaaatgcatattaaattgaaaaaacttatagaaaatataatcaattactttataatattgcattttaatatatcaatgaataaataagacttctttcatatattatactgaaaaataaaatatcgaagtttccattaaacctatttaataaaatgttaaaagagcaattttattttaaatatgtacatcagctgtgtttttccccttcagattaaatattttagccttctctcttaatttgtattgtgggagaaatttatgtctattttatgtagcttgtaactctggagttactgtatagaatttgtatacaatctagagttatagaattctgatactaaagttctcaagcattaggtatgttatatacagtattctcagacactgggttagttgtttactaagggagtagagtttcaagcaaatctcttagactagttagagccccaaagaatctaaaactaagcgatttattttaggactatgagggcactaatttagctgaaagagttgcagtttcatcctggacctctgaggttaatgagatatacttaagatgagataaatgtaaccacttctgcctgagtttcatcagtattctataaaagaaatgcagcattaaaaataaatgagctgggttatttatatatttatttatttattttaaacgtggaggctcatgcctctaatctcagcactttgggaggccaaggcgagaggattgcttgagctcacgagtttgagacccacctgggcaaaacagggagacctcatctttacaaaaaataataaattacctggacatggtggcatggggctgtagtcccagctatttgggaagctgaggtggaaggatcacttgacccttggaggtcgaggctgcagtgaaccgtgatcatgccactgaacttcagcctgggtgacagagtaagaccctgtctttaaaaaaaaaaaattaacaaataataaaatgaacttgaaatcc

SEQ ID NO: 113331 - DNA, 2099 bp, Homo sapiens
  Payload ID: 2156
  Gene Symbol: CARF
  Gene Name: calcium responsive transcription factor
  ENST ID: ENST00000414439
  CDS Start-End: 210-2081
attatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcagggagtagagctgtggtaatggagtgtcagtatgggccaagaagaaaaggtttccagttaaaaaaagtcagtgagcaggaaagcaggtcttgtcagctctacaaagccacttgtccagctcggatttacattaaaaaggtacagaagtttcctgaatatagagttcctacagaccccaaaattgacaagaaaattatcagaatggagcaggagaaagcttttaacatgctaaagaagaacttggtagatgctggtggtgttcttaggtggtatgtacagttacctacacagcaagctcatcagtatcatgaattagagactccctgcctcactttgtcaccttctccttttcctgtgtcttctcttgaagaagaggaaactgcagttagagatgagaattgtgcattaccctcacgtttacatcctcaagtagcacataagattcaagaattagtatcacagggaatagaacaagtgtatgcagtaaggaaacagctaagaaaatttgtggaaagggaactgttcaaacccgatgaggtacctgaaagacataatttatctttttttccaactgtaaatgatataaaaaatcacatccatgaggtacagaaatccttgagaaatggagatacggtatataactcagagattattccagcaacgcttcaatggactacagacagtgggaatattctcaaagagaccatgacagttacatttgcagaaggaaattcaccaggagaatcaattaccaccaaagtggaaacaaatcagaccaggggttctttgtctcctgagccaacccacttgctctcctcactctcctcatttcagcccaaaatatttacacaactacagggtttgcagttacaaccaaggtacacctctcctgatgaatcaccagctgtggtatcagtaaataaccagccgtcctctagtccttcaggacttctggatacaataggaagtgctgtaatgaataataattctctactgcttggtcaaagtcatagccttcaaagagatacatgcttaacccaaaacaatagtactgcctccaccatgggtaaccttccagaaccagatcaaaatctagttgcaatggacgagctggtagaagttggagatgttgaggatacagggaatctggaaggaactgttcatcggattctgttgggagatgtgcagactattccaatacagattatagacaaccactcagctcttattgaagaaaatccagaaagtaccatttctgtgagccaagttaaacaagaacccaaagaaccagcattgtctatggaagcaaaaaaaactgtggactataagaaattatctgctacataaattattgaagcttttcag

SEQ ID NO: 113332 - DNA, 2854 bp, Homo sapiens
  Payload ID: 2156
  Gene Symbol: CARF
  Gene Name: calcium responsive transcription factor
  ENST ID: ENST00000444724
  CDS Start-End: 281-1210
gcgcgctcccggtggggcgcgcctgcgcattatgctggtctccatggcggggcctcggagccaagacgagagaaaatgctgctgtgaagacccaattaaagctttcacataaatgaagctacagctatcatgatttagtgcccccaaaaggaagaacttcagtggacaagaaaggacatttctgggggtagtagaatgcttgaggcctggaatttaaacctgagccactatctgaagctattaaataatagaagaaaatggaattgaatatgatgtcagcatggaacaatctaatgattcattaagagtcaaccataatgacggtgaagagtcaaaaaccagtgctcaagtatttgagcatctaatctgtatggactccagggattcttcctttggacaaaatgattctcctacagttttgcccatcactactcgtgaagcaaataattcactcatatcacagaatataccagggcccctgactcagacacagactctttctgcagagcaattccatctagtggaccaaaatgggcaggctattcaatatgaacttcagtcattgggggaatccaatgcacaaatgatgatcgttgccagcccaacagaaaatggacaggtacttcgtgtaattccacctacccagacaggaatggcacaagtgattatacctcaggggcaacttgtggatgtgaatagtcctcgggatgtccctgaagagaaacccagtaacagaaacttaccaactgtaagagtggatactctagcagacaataccagcaattacattcttcatcctcaaacatccttcccattgcccaaaaagtcagtgaccggaatgctggaagaaccccttctggggcctcttcagccactttcttctaatacacctatatgggcctgccgtcttaggagctgtgagaaaattggagattcataccgtggctactgtgtaagtgagactgaattagaaagtgtcctaacatttcacaagcagcaaacacagagtgtttgggggacccgtcagtctccaagcccagccaagcctgctacacgcttgatgtggaaatcccagtatgttccatatgatggaatcccatttgttaatgcaggtacttttttaaagaattattttaaaaggttcagcagcagccatagtccattgtcaaaatgtgattttcctaaggtgataacatttttattttggtagctgacaattgaatgctaattgattaaaatgcatattaaattgaaaaaacttatagaaaatataatcaattactttataatattgcattttaatatatcaatgaataaataagacttctttcatatattatactgaaaaataaaatatcgaagtttccattaaacctatttaataaaatgttaaaagagcaattttattttaaatatgtacatcagctgtgtttttccccttcagattaaatattttagccttctctcttaatttgtattgtgggagaaatttatgtctattttatgtagcttgtaactctggagttactgtatagaatttgtatacaatctagagttatagaattctgatactaaagttctcaagcattaggtatgttatatacagtattctcagacactgggttagttgtttactaagggagtagagtttcaagcaaatctcttagactagttagagccccaaagaatctaaaactaagcgatttattttaggactatgagggcactaatttagctgaaagagttgcagtttcatcctggacctctgaggttaatgagatatacttaagatgagataaatgtaaccacttctgcctgagtttcatcagtattctataaaagaaatgcagcattaaaaataaatgagctgggttatttatatatttatttatttattttaaacgtggaggctcatgcctctaatctcagcactttgggaggccaaggcgagaggattgcttgagctcacgagtttgagacccacctgggcaaaacagggagacctcatctttacaaaaaataataaattacctggacatggtggcatggggctgtagtcccagctatttgggaagctgaggtggaaggatcacttgacccttggaggtcgaggctgcagtgaaccgtgatcatgccactgaacttcagcctgggtgacagagtaagaccctgtctttaaaaaaaaaaaattaacaaataataaaatgaacttgaaatcctatagtcttcctttttcccatcctagttttaatctccttaaccctccataggtagctactacatgaatttcatgtgtatcgttctagtctgtatttttatactttaccttacatattgtatctacaataatacattttattgttttggatttttaaaaaatgtataaatagtaaaatgtagatattgttttgcaaatattttcattcacccttttttttacatttattggtattgatagttataaatcctagttaatccaatttaatcattgtataatattccagcatgtgaccaaaccacaagtatttttctattgatcatcatttaggttgtttccaacttttcattattacaaagaatgctgtagtcaaacctccacactatatatactttaatgaaaagctgtaattagtttttctagagtatatgccttaaagtagaattgctggttgtgaattatgcccatttcatctttacaagattatcttaaaattgctctcaaggccgggcgcagtggctcacgcctgtaatcccagcactttgggaggccgaggcgggtggatcacgaggtcaggagatcgagaccatcctggctaacacggtgaaaccccatctctactaaaaatacaaaaaa

SEQ ID NO: 113333 - DNA, 1488 bp, Homo sapiens
  Payload ID: 2157
  Gene Symbol: CAMK1
  Gene Name: calcium/calmodulin-dependent protein kinase I
  Uniprot ID: Q14012
  ENST ID: ENST00000256460
  CDS Start-End: 179-1291
ggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaaccatcctt

SEQ ID NO: 113334 - DNA, 1423 bp, Homo sapiens
  Payload ID: 2157
  Gene Symbol: CAMK1
  Gene Name: calcium/calmodulin-dependent protein kinase I
  ENST ID: ENST00000397277
  CDS Start-End: 163-282
ccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgctctccccaggtggtggcaaagatgatcgccattagctccaggcttacatcctaccagctcaacaggagactcattctcaaagtgctagggggccttctcggaggtgatcctggcagaagataagaggacgcagaagctggtggccatcaaatgcattgccaaggaggccctggagggcaaggaaggcagcatggagaatgagattgctgtcctgcacaagatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatgcaagccttcaatgccacggctgtggtgcggcacatgaggaaactgcagctgggcaccagccaggaggggcaggggcagacggcgagccatggggagctgctgacaccagtggctggggggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgt

SEQ ID NO: 113335 - DNA, 950 bp, Homo sapiens
  Payload ID: 2157
  Gene Symbol: CAMK1
  Gene Name: calcium/calmodulin-dependent protein kinase I
  ENST ID: ENST00000421120
  CDS Start-End: 1-781
agactccaaaatcatgatctccgactttggcctctccaagatggaggacccgggcagtgtgctctccaccgcctgtggaactccgggatacgtggcccctgaagtcctggcccagaagccctacagcaaggctgtggattgctggtccataggtgtcatcgcctacatcttgctctgcggttaccctcccttctatgacgagaatgatgccaaactctttgaacagattttgaaggccgagtacgagtttgactctccttactgggacgacatctctgactctgccaaagatttcatccggcacttgatggagaaggacccagagaaaagattcacctgtgagcaggccttgcagcacccatggattgcaggagatacagctctagataagaatatccaccagtcggtgagtgagcagatcaagaagaactttgccaagagcaagtggaagcaagccttcaatgccacggctgtggtgcggcacatgaggaaactgcagctgggcaccagccaggaggggcaggggcagacggcgagccatggggagctgctgacaccagtggctgggggtgaggagcgggctctgcagaagggcatgggtggtccacaaaggtgcacccgggctggagtggagggcctgcccctgcggccacctctgttctgtcttcccatgcagggccggcagctggctgttgctgtcgagactgctgcgtggagccgggcacagaactgtcccccacactgccccaccagctctagggccctggacctcgggtcatgatcctctgcgtgggagggcttgggggcagcctgctccccttccctccctgaaccgggagtttctctgccctgtcccctcctcacctgcttccctaccactcctcactgcattttccatacaaatgtttctattttattgttccttcttgtaataaagggaagataaaacc

SEQ ID NO: 113336 - DNA, 560 bp, Homo sapiens
  Payload ID: 2157
  Gene Symbol: CAMK1
  Gene Name: calcium/calmodulin-dependent protein kinase I
  ENST ID: ENST00000411972
  CDS Start-End: 194-560
gagccgcaggcgggcggagagagccgccgagccgagccgagccccagctccagcaagagcgcgggcgggtggcccaggcacgcagcggtgaggaccgcggccacagctcggcgccaaccaccgcgggcctcccagccagccccgcggcggggcagccgcaggagccctggctgtggtcggggggcagtgggccatgctgggggcagtggaaggccccaggtggaagcaggcggaggacattagagacatctacgacttccgagatgttctgggcacgatcaagcaccccaacattgtagccctggatgacatctatgagagtgggggccacctctacctcatcatgcagctggtgtcgggtggggagctctttgaccgtattgtggaaaaaggcttctacacggagcgggacgccagccgcctcatcttccaggtgctggatgctgtgaaatacctgcatgacctgggcattgtacaccgggatctcaagccagagaatctgctgtactacagcctggatgaagactccaaaatcatgatctccgactttggcctctcca

SEQ ID NO: 113337 - DNA, 1578 bp, Homo sapiens
  Payload ID: 2158
  Gene Symbol: CAMK1D
  Gene Name: calcium/calmodulin-dependent protein kinase ID
  Uniprot ID: Q8IU85
  ENST ID: ENST00000378845
  CDS Start-End: 87-1160
cccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtgcgtatgtagcaaaaccagaatccctcagctgacactgaagacgagcctggggtggagaggagggagccggcatctgccgagcacctcctgtttgccaggcgctttctatacttaatcccatgtcatgcgaccctaggactttttttaacatgtaatcactgggctgggtgcagtggctcacgcctgtaatcccaacactttgggaggctgaggcaggaggactgtttgagttcaggagttttaagaccagcctgaccaacatggtgaaaccccatctctactaaaatataaaaattagccgggtgtggtggcgagcacctgtaatgtcagctacttgggaggctgaggcaggagaatcacttgaacccaggaagcggaggttgcaatgagctgagatcacaccactgcactccagcctgggtgacagattgagactccctctcaaaaaaa

SEQ ID NO: 113338 - DNA, 1725 bp, Homo sapiens
  Payload ID: 2158
  Gene Symbol: CAMK1D
  Gene Name: calcium/calmodulin-dependent protein kinase ID
  ENST ID: ENST00000615792
  CDS Start-End: 1-876
tactgtctcatgcaaagggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaa

SEQ ID NO: 113339 - DNA, 8153 bp, Homo sapiens
  Payload ID: 2158
  Gene Symbol: CAMK1D
  Gene Name: calcium/calmodulin-dependent protein kinase ID
  Uniprot ID: Q8IU85
  ENST ID: ENST00000619168
  CDS Start-End: 338-1495
ggaggaggcgcgaggtgggggggagcgcggcgggcggcagggagggagcgggagggaggcaagaaagtagcagaaagtgaggctggcaggcggcggcaaaggagccggcgcgcggcggcggcaggaagtctgtgcccgagaacagcagaaataagagccagggagggaccgcggccgcggcggcggcggcgagagcgaaagaggaaactgcagaggaggaagctgcgccgcagcccgagccgcccggcatccccgccgcctctgcgcccgcgccgcgcccccggcgccccctccccagcgcgcccccggccgctcctccgcgccgcgctcgtcggccatggcccgggagaacggcgagagcagctcctcctggaaaaagcaagctgaagacatcaagaagatcttcgagttcaaagagaccctcggaaccggggccttttccgaagtggttttagctgaagagaaggcaactggcaagctctttgctgtgaagtgtatccctaagaaggcgctgaagggcaaggaaagcagcatagagaatgagatagccgtcctgagaaagattaagcatgaaaatattgttgccctggaagacatttatgaaagcccaaatcacctgtacttggtcatgcagctggtgtccggtggagagctgtttgaccggatagtggagaaggggttttatacagagaaggatgccagcactctgatccgccaagtcttggacgccgtgtactatctccacagaatgggcatcgtccacagagacctcaagcccgaaaatctcttgtactacagtcaagatgaggagtccaaaataatgatcagtgactttggattgtcaaaaatggagggcaaaggagatgtgatgtccactgcctgtggaactccaggctatgtcgctcctgaagtcctcgcccagaaaccttacagcaaagccgttgactgctggtccatcggagtgattgcctacatcttgctctgcggctaccctcctttttatgatgaaaatgactccaagctctttgagcagatcctcaaggcggaatatgagtttgactctccctactgggatgacatctccgactctgcaaaagacttcattcggaacctgatggagaaggacccgaataaaagatacacgtgtgagcaggcagctcggcacccatggatcgctggtgacacagccctcaacaaaaacatccacgagtccgtcagcgcccagatccggaaaaactttgccaagagcaaatggagacaagcatttaatgccacggccgtcgtcagacatatgagaaaactacacctcggcagcagcctggacagttcaaatgcaagtgtttcgagcagcctcagtttggccagccaaaaagactgtctggcaccttccacgctctgtagtttcatttcttcttcgtcgggggtctcaggagttggagccgagcggagacccaggcccaccactgtgacggcagtgcactctggaagcaagtgactggccctggaggtggggcccggggtcggggctggggaaggggagccccagggtcgccagagccgcgagccactccagcgagaccccaccttgcatggtgccccttcctgcataggactggaagaccgaagtttttttatggccatattttctactgcaattctgaagtgttcatttctcacaaactgtactgactcgaggggcgctgatttcataggatctggtgctgtatatacgaatcttgcaaagctctaactgaacggaccttcttattcctctcccctaacaccatcgtttccactcttctcagtgtaggtaaccgtctatggtgtgttttttcattaatgacaaaaaaaaaaaggtttcaactggattatttaaatattggtaaatattgtgcattagggtttgtttttccttttaagaagtatgtcctttgtatctctaagttacatgacctatatcttttcctctttaatagtagttttatgttaacctttaagagatttgtttttcctcaaaggagaatttaaaggtattttttaaaattctaataagaggatcagccgggtgcaatgactcatgcctgtaatcccagcacgttgggaggccaagtcgggcggatcacaaggtcaggagatcaaggccatcctggccaacatggtgaaaccccacgtctactaaaaatacaaaaaattagccgggcgtggtggcacacacctgtagtcccggctactcgggaggctgaggcaggagaattgcttgaacccgggagacggaggttgcagtgagctgagatcgtgccactgcactccagcctgggtgacagagcaagactctgtctcaaaaaaaaaaaaaaaaattctaacaagaggatcatgaatctgtctccaaggctaagagtgcccttcacctctactccttctgtttctctccccttccccaggaggaggggcccctcagttctgcgaggctctcttctctgcgggggactttggtagagaatctgcacagagcctttgctggcaacccatccagcagaacccacacccaccagagaccctagaggcctcttgccatcagcaaccagaaataagcctgctcccccgagacgcagggctcagcttcacaggccagacttgctgtgagtgagatgcccacactgcagagatgcaggaccctcccttgcaaaaggaaccagctgccatgttgctgaaagtgggcccacacacaaccctcatttctcacgagagctaacagatgaaagctcagctatgcagtgttaaaattcatctctttctctgtggtttttaaaaaaatgcatttctaatcttacacttcacgtggcctccaacacaaagttctttctccacatttttaccctcttctcacatgaatgttttccaagggaaggaagggagggaagcagccttgggaaaggatccatttctggtggtaaggagagggggccctgccaggctaatgggacttcagccaccacagagatgaccaaagaccacctccgccaggcccagccagtgcttgcagccctcccattggtcaggggagtctaaaatcaaagatacatggtggtagggtcaccaaacgtcccatttgcccgagactgaaggatttctcaggctgtggacatttaatgccaaaaccaggaatatccggggcaaagcaggctgtgttgttcgcctttgtggagccaggcagtgtgtggcccagggaaagctgcgtttcatggaggcttccaggaggctgccctgtaaagccaggcaggtggcttcaagtgccattcctgcaagtgcccctgcttcagctctcaggcccatccaatgcctcgagcccacgggggtgtcccggcaggtctgcgtcatcacgacccagtaacgctgctggctgtgtcctcatgccctcttcctctggctggccagtcatgggaagtcctgttggttgagtcatctttgtcacttctacacctttgagtatgtacaggctgaatgttgagtgatgcccccccaccctctcaataaacacacacacacacacacacacacacacacacacacacaatgttattaggcacagcagctccatcctgctccctgagaatggcagtgcaggcacagagaagagcagttgggaagacaggcagctggtctaccctgtccccgcacacttcacaggcactccactgcttggcaggaattctgcatggcatctgccacgcatgctcacagggtgaaaaatcaagctgtcactctgcaaaatctaaaaaccctggaaaggtctataagatgacattagacccagttaagaagcaagtgtcacctgagttggccatgcaatgaatgaatattataagcagtattggagaactaggcggttgcttactaagaagtgtcttggaaacattcgagttcatacagtgcatgacaaagtaatagaaggctgcaagcgctgaaaatgcacccgaatctggtacctaggatgagtacatgaatagtgatgaatagccctttgtgctgtgtgctatatacaaccatttgcattcagaaagcagcatttgaagctgagttccattactggtgattgaagtattttcaggagcagatacatgtggtgcatgttatatgcacttagtttgaaagtatccctcacccaaaaagtgcagaacctctgaaaggtgagccgtggtgcaggtgcccccctcgctgttcgggtcagttcttggccatgcttggcctgtcacacgccgggtctcaacaacatcgtgcgaggagacagtgactggtttcagcccaagagtcaactgttgagcatgacatcaggaagcctgtactgtcctgatcccaccaggcttgggttaatttcctattgcttcagagaaagagaggcgctcttgtgcttttgagagagctctcatgttaaaaagaggttgtctttgcactgcgcttggtatgatttgttttcttataaaacaggaagagaacctagaatgtgcctttcgtgaaggtctgacaaatggggtctcagagtcctaggacccgcaccaaggtcagagtccacctgtagaggctgagcatttctacatgcacccagggtgctgggctgaggctaagggtggacgcgtagaccccatcacaggcttccttcctgagcccaagtcccccatttggtcactatcccttctcagagcaagtggattctcttttcctcacttggagtattcaatgttgaagtagtggcctggagtggcctttccctcagctgcctgtctgggctccctggcttcccggatcttcatctcatacgtgaggcaataggaggagtttctattcattgagacaaacagtgagcgggcaccaacaggccagcagcttggcccttttcacagaggtggccttggagtctggagtctgggcagctgtctgcctctctacggctctgcttcccagcgggcacacgggtccggagcctcagaatgaagtggtgcagaggcgcagggcacacctaggagaagctcaatgaccaccaaagcccttgaggagagacggggtttgctgtgttagagaaatggcaacccccaggaccatgcacggctctggcagtgcacagtggctgattttcaccagttcctcctacccctgcctctgtcggagactagaaaacattctaccccttcaggtcttcttttaaaagaaaagagctatggcaaagcgtgccatacaaagttaaaaaaaggaagagtggctttgcgttcttgaccatggccacaattctggtcacttctagcatctgaccttgagaacggtgtagagtctctgagccaccgctggcctttgagagagtctcactctccagctagctctttgtgtagtgtccagggccccggcagtcaggatagagcgagcaaaagaagatggacagtggacagggcgcagtggctcacgcctgtaatcccagcgctttgggagagcgaggcgggcagatcacaaggtcaagagatcaagaccattctggccaacatggtgaaaccctgtttctactaaaaatacaaaaattagctgggcatggtggtgcgtgcctgtaatcccagctactcgggaggctgaggcaggagaatcgcttgaacccgggaggcagaggttgcagtgagccgagatcgtgccactgcactccagcctgggtgacagagcaagactccgtctcaaaaaagatggccatgctggccaaggctgggctcataggaaatatctgtagtaggatgaaaggaatctggcctagggagccccggactcggtttacctaccccgtactcatcccactcatctgtctaccctagtgtccatcatgccctggatgaatcgtaggtgggagggacagaagccgagaacaccaggcacacggggtggggggaatggggggagcccaggtgatcccctttggaaagtggattgatcctctcccctgtggaatgacagcttaacctgattaacccactggggcttgctattttatgagcatttttaaacagaaaggaaagatgatatcccagtgcaggtagactttatttttgaaagcatcgtggcccctcacctctccctctcccccagaaccttggccagaattgagtcttcgcgttggggaggccacgctggaaccattgctctagggctgaaggtggaagtagggccactgccgcagcttcagccagagccctcgctgcttcgcagaatttaacaagcacacgactgggattcctttggatatgagaaaggaaggcaagtgcgggcaaagggaagctcctcccgtttttcataaacagaagtaagatgtcctctttcccaggtttgcacaatcacttctggcaaattaattgaaggtccttgaattcagccagtgcacgaaacctttgcatgttcttctgaaactgtacttcttccctattctgtctacccacactctgcgaactttgccttttccttaaacacattccagaccaaacactgttcagtttgttaaaaaaaaaaaaaaaaaaaaaagatgtatatacctgtatgtgatccaccacccttttgaggggcacctggtcctcggttggggctgcaggtgtgcctgacatttgcaaaagatattccagtctttcgatgttcagaattgaaaatgtggagatagaaaagctcaaacagactcctaaaaggagggtttctttcctgaagactccaagaaaatgagtgtgcagatgagttagcttgacaacctcaactctggggagcaggcaggcggtctgaggaagataagggcccacgccccactcacctggcacctgttcggtggtcccggggcatcatggtctgcagctctgggcccccagccccactgtgaagtcagtcctgcatgctggccgaggcccggccacctcccgatgcctccagagtcagtgggaaggagtcagcccttcccagacttccccgccacctccagcaggagcagctcagtttgtggctctgggagctccgcttttgcaaacccaaaaaggctgtgcatttggaagccaaacgctcagcatgcggctgccgagtctggttttgtggacaaagcaaactgtggaatggcttctcggtgtctgtataaagggacaaacggttgcattcaccctttgtactataacaccgcttctgcattcgccatatccgttttttaacctttttgtctccggggaacttctcattcgattattatgtcttctgatgatttgccatgttattttaaaggtgattttattttcttatggacaggaaaaaagaaaatgaggaggagttggttttactcttagagataagacttcagcaggggctcagaaaccccaaactctagttaaattgcttctcggaggaaaatcttaatctagacagattcagattcccaggctctcctggaagccctgcacttcagggcacaggggccctgggacgtggttggcagccaggctgcgagagagctaaaaaggaacaagaacatcagctcggatgtttgtctctcagccctgacacctgccactctccttcccggggcacttggccctatcagagggacatgaaatgctgtccgaatggtggcagaaatgcagcgacattgcatgcagcagagtctttgcttcgaaagatggggcgccatgtttcagagaacatttatcttagtcccacgttcaggtgagaagacctcaaaggtaccctctgtccagaataaacattggaacaatctctcaattggcttttgtcactacacataatgtaatctcccttctttcagctcccccaacagtgagcatgcttcccaaaaaattacaacatcaaaaccaggaatgtccccgcatctactattaccaggcttgcaattggttcaattttcccataaaaacatgtttgtccaaaagaagggaaactgtgaatttattccatgcatgtaataaactctgcaagaagtttaacccacataggtttgcggcactgcaaaattgttcatgggtctatgtagcaaatgattctctgccttgacaatcatgtatacatatcaagatttctatcataatgataatgagattgatgacttcctgttttcctccaataaagacaattaatcaccttca

SEQ ID NO: 113340 - DNA, 2612 bp, Homo sapiens
  Payload ID: 2159
  Gene Symbol: CAMK1G
  Gene Name: calcium/calmodulin-dependent protein kinase IG
  Uniprot ID: Q96NX5
  ENST ID: ENST00000009105
  CDS Start-End: 246-1676
acagacctgtaggagctggagtgggagctcaagcaggattcttcccgagtccctgggtaagacaaccctgcttcttttcttggctttagagggtctccttgcttaatgggaagcgtgcagcacctagtgagtggatttgaagagccactttgtaagcaacttgggcatttatttcagccccagttccagtcttccctgactcttttggcatcaaggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctct

SEQ ID NO: 113341 - DNA, 2440 bp, Homo sapiens
  Payload ID: 2159
  Gene Symbol: CAMK1G
  Gene Name: calcium/calmodulin-dependent protein kinase IG
  Uniprot ID: Q96NX5
  ENST ID: ENST00000361322
  CDS Start-End: 74-1504
gagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtggctccagaagtgctggcccagaaaccctacagcaaggctgtggattgctggtccatcggcgtcatcacctacatattgctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaaggccttgagtcatccctggattgacggaaacacagccctccaccgggacatctacccatcagtcagcctccagatccagaagaactttgctaagagcaagtggaggcaagccttcaacgcagcagctgtggtgcaccacatgaggaagctacacatgaacctgcacagcccgggcgtccgcccagaggtggagaacaggccgcctgaaactcaagcctcagaaacctctagacccagctcccctgagatcaccatcaccgaggcacctgtcctggaccacagtgtagcactccctgccctgacccaattaccctgccagcatggccgccggcccactgcccctggtggcaggtccctcaactgcctggtcaatggctccctccacatcagcagcagcctggtgcccatgcatcaggggtccctggccgccgggccctgtggctgctgctccagctgcctgaacattgggagcaaaggaaagtcctcctactgctctgagcccacactcctcaaaaaggccaacaaaaaacagaacttcaagtcggaggtcatggtaccagttaaagccagtggcagctcccactgccgggcagggcagactggagtctgtctcattatgtgattcctggagcctgtgcctatgtcactgcaattttcaggagacatattcaactcctctgctcttccaaacctggtgtctatccggcagagggaggaaggcagagcaagtggagcagggcttagcaggagcagtttctggccagaagcaccagcctgctgccagcggggcagcccctcataggaggcccaggagggagccccaaggcgtagaagccttgttgaagctgtgagcaggagaagcggtgcccaccagcttccaggtctccctgacctgcctgctctatgccccacaccctacgtgccgtggctctgtgcagtgtacgtagatagctctcgcctgggtctgtgctgtttgtcgtgaaaagcttaatgggctggccaggctgtgtcaccttctccaagcaaagccatatggagcatctacccagactcccactctgcacacactcactcccacctctcaagcctccaacctcttggccagattgggctcattaatgtcgttgcctgcccatctgcatgaatgacaggcagctccccatggtggtctgcctgtgagctcttcaagttctaatccttaactccaggattagctcccaagtgcgctgagacccagccagcacacttctggcccttctccctgcctcaatctaaaagcagtgccacaccctccaaagtggaatagaaagaagttcatgagtaagggctgcaaggaattcttatcctggccacatgtcctccgtgcacacacccaatggagttaaccttggaagttgactattttaatgtctgccaggagttctaatcctgcctctgttcccttttctctccttgaaagtccagcacaccattcttgtccttccccagtttcctcgccctccacccctccagcttcatgctcagtgttgtgcttaataaaatggacatatttttctct

SEQ ID NO: 113342 - DNA, 808 bp, Homo sapiens
  Payload ID: 2159
  Gene Symbol: CAMK1G
  Gene Name: calcium/calmodulin-dependent protein kinase IG
  ENST ID: ENST00000423146
  CDS Start-End: 74-808
gagctggagtgggagctcaagcaggattcttcccgagtccctggcatcctcagaagcttcaactctggaggcaatgggtcgaaaggaagaagatgactgcagttcctggaagaaacagaccaccaacatccggaaaaccttcatttttatggaagtgctgggatcaggagctttctcagaagttttcctggtgaagcaaagactgactgggaagctctttgctctgaagtgcatcaagaagtcacctgccttccgggacagcagcctggagaatgagattgctgtgttgaaaaagatcaagcatgaaaacattgtgaccctggaggacatctatgagagcaccacccactactacctggtcatgcagcttgtttctggtggggagctctttgaccggatcctggagcggggtgtctacacagagaaggatgccagtctggtgatccagcaggtcttgtcggcagtgaaatacctacatgagaatggcatcgtccacagagacttaaagcccgaaaacctgctttaccttacccctgaagagaactctaagatcatgatcactgactttggtctgtccaagatggaacagaatggcatcatgtccactgcctgtgggaccccaggctacgtgggctctgtggataccccccattctatgaagaaacggagtctaagcttttcgagaagatcaaggagggctactatgagtttgagtctccattctgggatgacatttctgagtcagccaaggactttatttgccacttgcttgagaaggatccgaacgagcggtacacctgtgagaagg

SEQ ID NO: 113343 - DNA, 5322 bp, Homo sapiens
  Payload ID: 2160
  Gene Symbol: CAMK2A
  Gene Name: calcium/calmodulin-dependent protein kinase II alpha
  Uniprot ID: Q9UQM7
  ENST ID: ENST00000348628
  CDS Start-End: 667-2103
tttccctgtaaaccttagaacccagctgttgccagggcaacggggcaatacctgtctctctagagatgaagttgccagggtaactgcatcctgtcattcgttcctggggaccatccggaatgcggcacccactggctgttaccatggcaactgcctttttgccccacttaatcccatcccgtctgctacaagggccccacagttggaggtgggggaggtgggaagagaaaagatcacttgtggacaaagtttgctctattccacctcctccaggccctccttgggtccatcaccccaggggtgctgggtccatcccacccccaggcccacacaggcttgcagtattgtgtgcggtatggtcagggcgtccgagagcaggtttcgcagtggaaggcaggcaggtgttggggaggcagttaccggggcaacgggaacagggcgttttggaggtggttgccatggggacctggatgctgacgaaggctcgcgaggctgtgagcagccacagtgccctgctcagaagccccgggctcgtcagtcaaaccggttctctgtttgcactcggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaaggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgctgcgttgctgtgccgcagagatccactctgtccgtggagtggagctgctggttctcccaggtggattttgctggaattctcccatgtcatcaccccaccaccgtcacttctgtacctgcatcaagaaaacctgcttgttcacaaaagtcatcgcaacttcagagcgaacggccacatctccccacctctcacccccaccctctcccctgccaggctggggcttcctcaggcatgggtgtccacagcactggccccctctccccagcctcagctgctgtccgcctgatctgtcttgggctgtaggctagaatgcccgggctggtgcccaccaggggctggggagaaggaggggtggcatgatgaggaaggcagcatccgtccgtccctctcccagacctctcctcttccagtgtccccggggaagggcagatgacactcccttccccctaagccaaccgcactgaaggagtggggagaagagcatacgccaggagcctcctgcctcaaagtgctcccctaagtcttcttcctcctgtgctgacctcagggtggtctgacccttccctcggtgtgggggatgtggccctctcaggtgcccctacttgctttctgcttccttctggtgaagtccacctccaacattaacctgcccaccccacccccgtcatccctggagaattccagctttgtcgtatctcagagagggaatctaattgtttttggggggcaaaagaaagcaacgtttaggtatcacttctacttggaccgcatgcctttttatagccaaatttctgtgtatttcgtaaatggatttcgcgttaatggatatttatgtaataactagacttctcagattattgtgagaagggtcaggttggaaggggtgtaggaagaggggtgaggggtagtttttttctgttctagtttttttttttttttttgtcatctctgaggtggaccttgtcacctgtggttattggggccaaggtggactcagctccggggagaagggcctctctgccatttcggtcccaaggtgagctgacacaggcgttccttttgggactgtggaagcatcagatgccagcactgactcaggaacagcaagtcagggcagagaggaggagggaggctgtcaggatggaaatacctggacttttctttgcttccctcgcaaactggggtcttctctaccgaacttcccaggatttcatctcaccatatctgtgtgccgcccccagcaccccccacccacctctggggggcccgtgagcgtgtgtcttcattgcctctctccccttggcgtctgatgaccacagcaaagcactgggaatttctactcttcatgcctcatcctgcagcctcgggttcgcattctctctttcttttcctctttccctctttccctgggattgactctgagtggaataccttggcacatccactaggatctactgtctgcactgttttctttgcatgactttatacgcagtaagtatgttgaaaacaaacaaaaagaagaaaacactcaacaaaaccaatctacatgttttggactaaaaaaaaaaatagaggttgtattctcagtgtccgactcggaattatgttgctgcctctctgtgcttttggcctctgtgtggccgtgttttgccagcatgagatactgtcccctctggaggattttaggggaggaagagccacgtccccagggattggaggaggctccggtaccctcgaccctcctgggtgttggttggagcagaactggtgaggatgtttgatccgagattttctgagctctccccaatcaccagctgtctgctgggttcttttctcaagtcctgctgcccaggcccaggtgagacaggcaacgccaggtctgcaggccaggagagatgctgcccaggcctcctggtttccaagctggtccatcactggcctctgtccttggcagagaccttgctgcccaggcccaggggcaggctcttggcctgccccaggcccagagggcttcccagtaaggcccagtgatcccattatcccaggggcaaaaccacctgtccccttttgagctgccagttccctacagccatccccagtcaagggtgagggtgtggccttcaccaggggctgctgtaattaccgagcaaggtctgagctcttcttcagcctcagttccctcattggttaaaagggttctttgttcccatccagccgatgaaggagcaaacgtctggctatgtgaagcctaatttacctgcaggaactggcagggatagtcactggctggactcctgtttacttctagacctggtcaggctccatcccctcccccacctgcccctgattcccctcgtcggtgcctgtcaactgcttttcagcagtggactgcaggggaaagagcagtgatttggggtgagtaggcttcaattcccagctctgaccagacttgctgtgtgaccttgggcaagttcctttccctctttggagcttggtttccctgccagaggaaactgagctggaggagcctgaggtcctgcctttcattggctgacacacctcctgtccactgtgtcactctccaagtgccagagaagtggaggcagatcgctaccccaggctgagatggcccccactgtgaaggccacgcctgtgggtgggcagccacctggtgccaccacagggcaccagggatgatcctgatgtggcaggcaggggagactcacagaaaaatctgcccagagcctaccctcaccagacaaactctgtgctcctccaaaacatcctttagatgcaaaataataataataataataataaataaataaataaaaatccaaacccaagtcaaaaccttggctccagcatgaaaacacgtttacaggaaagtgttctcctgggtttgtgcccaccatggtgcgaatcctgacccaaggcctcctgtctcccttcaaagggagacccttttgggggatgagtttgccagactccccgtgctggtttctttgttactatttgtttggggttttgttttagttctttttttttttcttttcttttttaaaaatatgtggctgtgaacttgaatgaacactgctcaaactttctgctattggggggggcgggtgggatgggaagaaggggcgtttgttttattcttggtgttttcagtgcaataaatagctacaaacttctgtgca

SEQ ID NO: 113344 - DNA, 1493 bp, Homo sapiens
  Payload ID: 2160
  Gene Symbol: CAMK2A
  Gene Name: calcium/calmodulin-dependent protein kinase II alpha
  Uniprot ID: Q9UQM7
  ENST ID: ENST00000398376
  CDS Start-End: 5-1474
caggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtgaagctggcagactttggcctggccatagaggtggagggggagcagcaggcatggtttgggtttgcagggactcctggatatctctccccagaagtgctgcggaaggacccgtacgggaagcctgtggacctgtgggcttgtggggtcatcctgtacatcctgctggttgggtaccccccgttctgggatgaggaccagcaccgcctgtaccagcagatcaaagccggcgcctatgatttcccatcgccggaatgggacactgtcaccccggaagccaaggatctgatcaataagatgctgaccattaacccatccaaacgcatcacagctgccgaagcccttaagcacccctggatctcgcaccgctccaccgtggcatcctgcatgcacagacaggagaccgtggactgcctgaagaagttcaatgccaggaggaaactgaagggagccattctcaccacgatgctggccaccaggaacttctccggagggaagagtgggggaaacaagaagagcgatggtgtgaagaaaagaaagtccagttccagcgttcagttaatggaatcctcagagagcaccaacaccaccatcgaggatgaagacaccaaagtgcggaaacaggaaattataaaagtgacagagcagctgattgaagccataagcaatggagattttgagtcctacacgaagatgtgcgaccctggcatgacagccttcgaacctgaggccctggggaacctggttgagggcctggacttccatcgattctattttgaaaacctgtggtcccggaacagcaagcccgtgcacaccaccatcctgaatccccacatccacctgatgggcgacgagtcagcctgcatcgcctacatccgcatcacgcagtacctggacgctggcggcatcccacgcaccgcccagtcggaggagacccgtgtctggcaccgccgggatggcaaatggcagatcgtccacttccacagatctggggcgccctccgtcctgccccactgagggaccaggctggggtcgc

SEQ ID NO: 113345 - DNA, 540 bp, Homo sapiens
  Payload ID: 2160
  Gene Symbol: CAMK2A
  Gene Name: calcium/calmodulin-dependent protein kinase II alpha
  ENST ID: ENST00000510347
  CDS Start-End: 269-540
aaaagatcacttgtggacaaagtttgctctattccacctcctccaggccctccttgggtccatcaccccaggggtgctgggtccatcccacccccaggcccacacaggcttgcagtattgtgtgcggtatggtcagggcgtccgagagcaggtttcgcagtggaaggcagcacgggcaggcaagtggtccctaggttcgggagcagagcagcagcgcctcagtcctggtcccccagtcccaagcctcacctgcctgcccagcgccaggatggccaccatcacctgcacccgcttcacggaagagtaccagctcttcgaggaattgggcaagggagccttctcggtggtgcgaaggtgtgtgaaggtgctggctggccaggagtatgctgccaagatcatcaacacaaagaagctgtcagccagagaccatcagaagctggagcgtgaagcccgcatctgccgcctgctgaagcaccccaacatcgtccgactacatgacagcatctcagaggagggacaccactacctgatcttcgacct

SEQ ID NO: 113346 - DNA, 557 bp, Homo sapiens
  Payload ID: 2160
  Gene Symbol: CAMK2A
  Gene Name: calcium/calmodulin-dependent protein kinase II alpha
  ENST ID: ENST00000515758
  CDS Start-End: 485-557
atgtgcaattctctcctgaagtgagagggcccagcgggatctgcttgtagaggtgaagtcggccatttagtctggctagagtatagggcctgaggaacaggcctggaggagtctcggagaagcctcacatttaagaatcatggaaacggaggccagagagggcgagggatgtgcttgagtcactgcaacccaggcctcttcctctttccactgcaccccatggtcttcctggagaactcagaggccctggccagaagaccatcagaagctggagcgtgaagcccgcatctgccgcctgctgaagcaccccaacatcgtccgactacatgacagcatctcagaggagggacaccactacctgatcttcgacctggtcactggtggggaactgtttgaagatatcgtggcccgggagtattacagtgaggcggatgccagtcactgtatccagcagatcctggaggctgtgctgcactgccaccagatgggggtggtgcaccgggacctgaagcctgagaatctgttgctggcctccaagctcaagggtgccgcagtga

SEQ ID NO: 113347 - DNA, 1652 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000258682
  CDS Start-End: 4-1557
gccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctc

SEQ ID NO: 113348 - DNA, 2292 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000350811
  CDS Start-End: 76-1704
gtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggacaaactgc

SEQ ID NO: 113349 - DNA, 1624 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000353625
  CDS Start-End: 11-1450
cgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaa

SEQ ID NO: 113350 - DNA, 1448 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000346990
  CDS Start-End: 4-1353
gccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctc

SEQ ID NO: 113351 - DNA, 1577 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000347193
  CDS Start-End: 4-1482
gccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaaggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctc

SEQ ID NO: 113352 - DNA, 1683 bp, Homo sapiens
  Payload ID: 2161
  Gene Symbol: CAMK2B
  Gene Name: calcium/calmodulin-dependent protein kinase II beta
  ENST ID: ENST00000353185
  CDS Start-End: 65-1153
cgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctg

SEQ ID NO: 113353 - DNA, 1895 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000358707
  CDS Start-End: 205-1716
gcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaa

SEQ ID NO: 113354 - DNA, 1557 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000395747
  CDS Start-End: 1-1557
atggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtga

SEQ ID NO: 113355 - DNA, 4447 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000395749
  CDS Start-End: 78-2078
ccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccccagggtccccgacatcctgagctcagtgaggaggggctcgggagccccagaagccgaggggcccctgccctgcccatctccggctccctttagccccctgccagccccatcccccaggatctctgacatcctgaactctgtgagaaggggttcaggaaccccagaagccgagggccccctctcagcggggcccccgccctgcctgtctccggctctcctaggccccctgtcctccccgtcccccaggatctctgacatcctgaactctgtgaggaggggctcagggaccccagaagccgagggcccctcgccagtggggcccccgccctgcccatctccgactatccctggccccctgcccaccccatcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggaca

SEQ ID NO: 113356 - DNA, 567 bp, Homo sapiens
  Payload ID: 2161
  Gene Symbol: CAMK2B
  Gene Name: calcium/calmodulin-dependent protein kinase II beta
  ENST ID: ENST00000421607
  CDS Start-End: 27-567
gcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagctgcacggggagcttggggcctccacccactcacgttggcaaaatcaccatgtccagtggcctgtggattggtgctcggtggacacggatgcgtgtgccccagcaggctgggacccccaaggtgacg

SEQ ID NO: 113357 - DNA, 552 bp, Homo sapiens
  Payload ID: 2161
  Gene Symbol: CAMK2B
  Gene Name: calcium/calmodulin-dependent protein kinase II beta
  ENST ID: ENST00000433930
  CDS Start-End: 1-552
aagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagggatggatgacatcccagggctgctgccacccccacctgtggggagacaccagactg

SEQ ID NO: 113358 - DNA, 4142 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000457475
  CDS Start-End: 211-1767
aggtgtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagcagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaacaaaaaaaactaaaggaaggaaaaagctgtaaaaatcactggcattcgtggggccactccccacccaagctccacgtgtgtccgtctgtgctcctggcctctgggggaccagctgggacatgaacttgtctgccaggcccccgtcgcgtgctgaacggtgttagtttgtaggtaacgcacacaccccacacctaaggtgtctgcatcctcctgccaacgcatgggctccacgtggtgtgctcgctggctgtcgtgactgtcagctgtctcttgggaggggctgtgggggcccgctgggctgcctcctttcccgctagttgtgcctgagagttgctgttgttcctgctttcccttcccttcctttcatcccctgaagggctaggtgtgggttttccgtgcccggtatccccacacacccagcacggacaacccttcggcagagcccaggccggcccctcaccccctggagtattgaaactggagtcccgtccccaaggccttcagagatgcccctacacacccagggctccagctctggtccttctgggggagtaaagtgcaaagaggggcacagcttagttttgggcctctcgccgagcaagagacagcactgctggctacagctccaacacagccagctgtggcaagaggactctgcctgggctggcccccctcctgtgtgaggtgtctgtcccttctctgctggccagcagcagatgcactggcagctcccaaccctgtttccgcccctcggccctcccccagcctgttcggcttctctgcagcccgcaagggggagcagacttttgacaaaggactgcgggcctcgctcaagtccctgagcccccagctgaagctgggaggggaggccaggctttgtgtctgggcatattcgtctgctgatggggtttggggaagcctggggcttggggtttggtcgggtggtgcagctagtggcagagcgggatcagaggtggtggctgcccagcttctgggctgagacaagggtctgtgcaggggtttactgaagtgggagtgcctttggaatctgggccgggagcagaagggagcaaaagctacagtgggagccagcctagggcacatgggaggcgtgagggcagtgctgcccgtgcagtgtcaggtgtgccagtgccttggcgggctgcagtgcgtgtgagggcaccttctaggtgggccagggatgcagctatggagataaggcgggctggggacagaaacaggtgggcacagggcccaggacaccagcggatggagggcagggtctagccctgtgctcctgagcgtcggctgcctgggttcgaggcggtgggtccccggccccttgtgatggtgtgtaccatgggggagctcggggacagggcaagcccgagcatggtggggctgcagggtgggtctgaagccaggttgggtgggggtggtcacaagccctgactgcagagggtcaggggctcctgccccagtgcctgcccactttcaattcacattgttttcaacaaggattttctttatcttcccctacaaatcaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctgggccatgggacagcggcagggctcaccacggacagcacgtggcccagcagccggccaccctggcgtcctggggcctcctcccctcctctccctctcaccttgtcacctccacggagctgcctgtctgggataatttggggattttttttctgggggataattcttttgcatgacccctaaagagcaagccacaccggtctgctagctaggtgtccgcggtgtggtggtggcggccgctggccagcgctgcaaggggtcggctgcccacggtgctggctggcctcccctcctctctctttttgctgagtttcattgtcttttctttctgagccttgtaagtgtacaaaaattattcttattttgttctgtctcgggaaactgcaaataaaagaaaaacaggacaaactgc

SEQ ID NO: 113359 - DNA, 559 bp, Homo sapiens
  Payload ID: 2161
  Gene Symbol: CAMK2B
  Gene Name: calcium/calmodulin-dependent protein kinase II beta
  ENST ID: ENST00000415369
  CDS Start-End: 40-559
gctgagacctcgagggagagggcgagcccagcccccttcatgcggatccctgagtgggtggctggctccccggtcttcacccctcagatgcaccgatctacccccgtctgtcctcttggcctccagaggtgtcctggccactggaggggcaggggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagact

SEQ ID NO: 113360 - DNA, 2097 bp, Homo sapiens
  Payload ID: 2161
  Gene Symbol: CAMK2B
  Gene Name: calcium/calmodulin-dependent protein kinase II beta
  Uniprot ID: Q13554
  ENST ID: ENST00000440254
  CDS Start-End: 236-1864
gcggcgcccgcgcctccccgcgcgtaggtgtgcggcgcgctcctggcgaggacggagcgagcagatctcgcgtgcgctcgccgcccggcgcagcccagcccggcccccgcctggcgccgcgagccgaggtgtctcccgcgcccgcgcccgtgtcgccgccgtgcccgcgagcgggagccggagtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaa

SEQ ID NO: 113361 - DNA, 558 bp, Homo sapiens
  Payload ID: 2161
  Gene Symbol: CAMK2B
  Gene Name: calcium/calmodulin-dependent protein kinase II beta
  ENST ID: ENST00000424197
  CDS Start-End: 54-558
gtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtgcgtctccacgacagcatctccgaggagggcttccactacctggtcttcgatctggtcactggtggggagctctttgaagacattgtggcgagagagtactacagcgaggctgatgccagggccactcgcactaacccacctgctgtttgccacagtcactgtatccagcagatcctggaggccgttctccattgtcaccaaatgggggtcgtccacagagacctcaagccggagaacctgcttctggccagcaagtgcaaaggggctgcagtgaagctggcag

SEQ ID NO: 113362 - DNA, 867 bp, Homo sapiens
  Payload ID: 2161
  Gene Symbol: CAMK2B
  Gene Name: calcium/calmodulin-dependent protein kinase II beta
  ENST ID: ENST00000425809
  CDS Start-End: 1-555
ctacccgcagtatcacttacagggatggatgacatcccagggctgctgccacccccacctgtggggagacaccagactgggggtggtgtggagatactcttagagaagaggctgctgggccacgggctcggcatggcagggcagtggctagcccggaagcaggagatcattaagaccacggagcagctcatcgaggccgtcaacaacggtgactttgaggcctacgcgaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagagctgcgccctggtttcgccggacagagttggtgtttggagcccgactgccctcgggcacacggcctgcctgtcgcatgtttgtgtctgcctcgttccctcccctggtgcctgtgtctgcagaaaaacaagaccagatgtgatttgttaaaaaaaaacaaaaaaaaaaaaaaaaaaaacaagatgacgacgacaaccacaaaaaaaattgacatcagatgaaatgaaaaaaaaaaaaaacaaaaaaaactaaaggaaggaaaaagctgtaaaaatcactggcattcgtggggccactccccacccaagct

SEQ ID NO: 113363 - DNA, 1856 bp, Homo sapiens
  Payload ID: 2161
  Gene Symbol: CAMK2B
  Gene Name: calcium/calmodulin-dependent protein kinase II beta
  ENST ID: ENST00000523845
  CDS Start-End: 55-393
agtcgccgccgcccgagcgcagccgagcgcacgccgagcccgtccgccgccgccatggccaccacggtgacctgcacccgcttcaccgacgagtaccagctctacgaggatattggcaagggggctttctctgtggtccgacgctgtgtcaagctctgcaccggccatgagtatgcagccaagatcatcaacaccaagaagctgtcagccagagatcaccagaagctggagagagaggctcggatctgccgccttctgaagcattccaacatcgtcactgtatccagcagatcctggaggccgttctccattgtcaccaaatgggggtcgtccacagagacctcaagccggagaacctgcttctggccagcaagtgcaaaggggctgcagtgaagctggcagacttcggcctagctatcgaggtgcagggggaccagcaggcatggtttggtttcgctggcacaccaggctacctgtcccctgaggtccttcgcaaagaggcgtatggcaagcctgtggacatctgggcatgtggggtgatcctgtacatcctgctcgtgggctacccacccttctgggacgaggaccagcacaagctgtaccagcagatcaaggctggtgcctatgacttcccgtcccctgagtgggacaccgtcactcctgaagccaaaaacctcatcaaccagatgctgaccatcaaccctgccaagcgcatcacagcccatgaggccctgaagcacccgtgggtctgccaacgctccacggtagcatccatgatgcacagacaggagactgtggagtgtctgaaaaagttcaatgccaggagaaagctcaagggagccatcctcaccaccatgctggccacacggaatttctcagtgggcagacagaccaccgctccggccacaatgtccaccgcggcctccggcaccaccatggggctggtggaacaagccaagagtttactcaacaagaaagcagatggagtcaagccccagacgaatagcaccaaaaacagtgcagccgccaccagccccaaagggacgcttcctcctgccgccctggagcctcaaaccaccgtcatccataacccagtggacgggattaaggagtcttctgacagtgccaataccaccatagaggatgaagacgctaaagcccggaagcaggagatcattaagaccacggagcagctcatcgaggccgtcaacaacggtgactttgaggcctacgcgtgagtccctggggctgggggggggctgtgcaggacaaggatgtgggacccttgggggggcctgctcagagtcaggggtccacggggcccctcctcacttggatttggcccccaggaaaatctgtgacccagggctgacctcgtttgagcctgaagcactgggcaacctggttgaagggatggacttccacagattctacttcgagaacctgctggccaagaacagcaagccgatccacacgaccatcctgaacccacacgtgcacgtcattggagaggatgccgcctgcatcgcttacatccggctcacgcagtacattgacgggcagggccggccccgcaccagccagtctgaggagacccgcgtgtggcaccgccgcgacggcaagtggcagaacgtgcacttccactgctcgggcgcgcctgtggccccgctgcagtgaagccaagggaggggcacagaatggggaacaggacacaggatcctaaactccaaggggactgtccaccgatgaacactcagagtggacaccatcttccgtccacgctgtgcccaggacagctgtccccatccatgaacacagggtaaacatctgccgggctccgcaccagtggctccctg

SEQ ID NO: 113364 - DNA, 5820 bp, Homo sapiens
  Payload ID: 2162
  Gene Symbol: CAMK2D
  Gene Name: calcium/calmodulin-dependent protein kinase II delta
  Uniprot ID: Q13557
  ENST ID: ENST00000296402
  CDS Start-End: 860-2296
aaaggagggagtgcgagagatccacgaagggacaggcttggagtcgctagagggaggtgtgggaccagcgaggagggggcttcgccagggagggggtgctggcaggcggagggagcggcgggaggaggcgccggaggaggagacggaggcctggggacggcagaagaggcttcgcctgagccgagcgctctttctctcgccgcgccgtcttgaagccgcgcgggctcgtgagcagcgcgaggccgccaaggtgcctcgcttcgccggagccgctgccgcccgccggagggaagccggcctcgggcgcgcacgctcgtcggagccccggcgcgccccgcgcctgagcctgctgacagcggccgctgggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatgctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 113365 - DNA, 1940 bp, Homo sapiens
  Payload ID: 2162
  Gene Symbol: CAMK2D
  Gene Name: calcium/calmodulin-dependent protein kinase II delta
  Uniprot ID: Q13557
  ENST ID: ENST00000342666
  CDS Start-End: 1-1500
atggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttg

SEQ ID NO: 113366 - DNA, 1642 bp, Homo sapiens
  Payload ID: 2162
  Gene Symbol: CAMK2D
  Gene Name: calcium/calmodulin-dependent protein kinase II delta
  Uniprot ID: Q13557
  ENST ID: ENST00000379773
  CDS Start-End: 63-1499
gccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtt

SEQ ID NO: 113367 - DNA, 2696 bp, Homo sapiens
  Payload ID: 2162
  Gene Symbol: CAMK2D
  Gene Name: calcium/calmodulin-dependent protein kinase II delta
  Uniprot ID: Q13557
  ENST ID: ENST00000394522
  CDS Start-End: 496-1974
gggctcaggctgtccgctctgggctccgcggcctcggccccgctgcactccacctccgccccctcggactccctcccctctgcttctactcctcctgctccagtgcggatcgtttcgcaactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagccccaaactactgtaatccacaaccctgatggaaacaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtttatgattctctggaaagatcaatcagatcagccatttgtgggttgaaacttgctatagagcagtatatgataggtttagacaggacgagagactacgtgatcaaaatctcacagggttaaatctagaggacttgtataataaggcaaaatatttgtgacttcatcttctcaattgacagaagaaggggatatcagaggaaaacatagggaggagtttctaaaatggccaatatattatcaggagtttcatttcatagatgatcccctaaagctcagttagagagacagcatttaaaaggccattgtcaggtagtgcaatgtcattctcacctcaccactctacctcagatatcatttgcttttccagtcagcgattaggcacatatttattgtgaatcacctaggtgcttaatctgtgccagattcaacacaaagtacaagatattgctttcaagaaacatgtattctcatttagccaatcattgattctaaagaaaaaaatgatataataaagtttatcatcaacttcagaatacagtagagttaatgaacagtgtagtaaactgtttataacagttt

SEQ ID NO: 113368 - DNA, 5294 bp, Homo sapiens
  Payload ID: 2162
  Gene Symbol: CAMK2D
  Gene Name: calcium/calmodulin-dependent protein kinase II delta
  Uniprot ID: Q13557
  ENST ID: ENST00000394524
  CDS Start-End: 378-1814
aactgcttgccactcgtcccgtgcctggctgtttttccatttcccggccccctcttcttgagtactttaccccctgcatttggggacagggactggaaaaggggcgggtggagcgtccagtggagaagaaggaagcgaggcccgcaggaggaggaggatcggcggactgtggggaggagaccccacgccaccctttctggtcatctcccctcccgccccgcccctgcgcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaactaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaacccttcctcttttctctcatctcacctctctgtgttgattactaatcatcttagatattattgctagtggatgtatggtagatgggttgaagcttttctgataattattacacaatttaaaacaacatatatatttaaaataaatatatacagtaaatatattgagccatgttaacctgccaatgagatctgtgaaaaaataatggcctcatttttctctttttaatttcttttacccttttgtgaagcagctatacgtggcatacatgtatttaaagaaaaaaaaatagatgtagagtgttttttttacacttttaacttagcatgtggtgttgaagtattactgtagatcaagtttgtcttccgcactaagatgtgaggaaattgtgatttgttctctccaccacaaatgaattacacatttattatcttctatcattttgaaacactgcagtttaccatgggacactgtatatatttcttgccataatggtaaaggactgattgatatatttaagagttaataaatttgtgatttctgctgacagtgcgtccatctttatttcttcagaagaggtactgtatgtatgcctgcatagtgctggccagtgtcaagggcagtgtgtcctactctggtctcatttagtacataacaatttgcacttggtgagaatggcaagttaattgttctctgtgagcaaaacaatggtctcttctgggaaaatgttgctgagaacaatatagttaacaactaagactcctaaaagcttctctaaactgtaccctccaatccagccttcacatggctgctttttttttttttttttaatacgaacctgtccttgtaacactttgatgttatcatttctgggatacaggcaagcaccccagctcctgctactccccagcttgaacttgagcatacatggatgctcagcttcttttgatttgctaaaaacatcacacttgctcacatgcctgtttatgctgttcatgttgtttatgtttcttacctagaataaatagtctcttcccctacttcttttcccgacttcttactttttcctaagattcagtgtacagcatcatgctccacagcaaaccttcctaggccctattctgggcttgccttccctctcaaaacctacataatagattgtatttacctctcctgtcaaccacattgttttgaaaatatatttctatttgtgtctcctctactgcagtataatgtctccatgggcaagaactgtgtattcatcattgcattcctaaacccaaaccaaggccaggaatggagatatcattgataaatagttgttgaattgaggccaagcccttttgataacagaagcctcaaggggtacccagatagtccttgttttaatgatgggttctctcaccactgtcttgatgctctgagcaagttacctcttccctctgaccctcagtttccatatttgtaaaatgagaataaacataccaacttaataaagatattgtgaggattaatgggtacagagtgactagaatgatatttgatagaaattaaatggtagcagtataactattctgatcactgacattaatattcctattgttattattctttgctcacgagggtatacaactcttgttttgctgttgggctgccctctttatgtaggtttactgttaatgctgaggatatactcggactcaaatgtctcagcagaaggctgagagacaccaaatgaagtggtcatctagctgaatgtaggaaaaatgaaatgtagtagcaaatcagtatattctaaggaaattttcaaggaatattaatcttcacccaaattttgaatttttatgtaaaaaattataatttaagggtaaacatagatgacacagctttcgagtgatttcattgaataaaattctactgacttctatgaa

SEQ ID NO: 113369 - DNA, 1470 bp, Homo sapiens
  Payload ID: 2162
  Gene Symbol: CAMK2D
  Gene Name: calcium/calmodulin-dependent protein kinase II delta
  Uniprot ID: Q13557
  ENST ID: ENST00000508738
  CDS Start-End: 1-1470
atggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagaaaaggaagtccagttcgagtgttcagatgatggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaa

SEQ ID NO: 113370 - DNA, 1533 bp, Homo sapiens
  Payload ID: 2162
  Gene Symbol: CAMK2D
  Gene Name: calcium/calmodulin-dependent protein kinase II delta
  Uniprot ID: Q13557
  ENST ID: ENST00000515496
  CDS Start-End: 1-1533
atggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagaaaaggaagtccagttcgagtgttcagatgatggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaa

SEQ ID NO: 113371 - DNA, 1497 bp, Homo sapiens
  Payload ID: 2162
  Gene Symbol: CAMK2D
  Gene Name: calcium/calmodulin-dependent protein kinase II delta
  ENST ID: ENST00000514328
  CDS Start-End: 1-1497
atggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgtatacagcagattctagaaagtgttaatcattgtcacctaaatggcatagttcacagggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaa

SEQ ID NO: 113372 - DNA, 583 bp, Homo sapiens
  Payload ID: 2162
  Gene Symbol: CAMK2D
  Gene Name: calcium/calmodulin-dependent protein kinase II delta
  ENST ID: ENST00000509594
  CDS Start-End: 1-583
attctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagccaagagtttgttgaagaaaccagatggagtaaagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatg

SEQ ID NO: 113373 - DNA, 1802 bp, Homo sapiens
  Payload ID: 2162
  Gene Symbol: CAMK2D
  Gene Name: calcium/calmodulin-dependent protein kinase II delta
  ENST ID: ENST00000505990
  CDS Start-End: 116-1654
ggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgcattcagcagatcctggaggctgtgctacactgccatcagatgggcgtggtccatcgggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagataaacaacaaagccaacgtggtaaccagccccaaagaaaatattcctaccccagcgctggagccccaaactactgtaatccacaaccctgatggaaacaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatggtcagctccttctacttattccattgttaatagcatggtatatgttatttaacgctagtagttggttacactgatgaaaataaatgccttcacgggaaaggtttatga

SEQ ID NO: 113374 - DNA, 2142 bp, Homo sapiens
  Payload ID: 2162
  Gene Symbol: CAMK2D
  Gene Name: calcium/calmodulin-dependent protein kinase II delta
  ENST ID: ENST00000513132
  CDS Start-End: 1-547
aagaaaactaaagggtgccatcttgacaactatgctggctacaaggaatttctcagcagccaagagtttgttgaagaaaccagatggagtaaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagtaaatatttccaggctgtcagcttctttgttaatacacccatgctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggtttttttttttttttttaaggtaaaaaaaaaatacaccttcagtttcctggtgtgatcctggttaaaatggatgatttttcattgaaagttttgctgattaacaattaaagtgggatgatatgtgggcaaaatcacttatgaaagtagaagcaagaatcagttggtttgctaccacataaagccatgctgtttttggtcaaactgtgtaaactggaaaaattcacatcatttctgagtttaatcactttaggatatattcacattgttttggtgaatttgctgaattgaattgtttttctttctcaaatctgtgatctcttttctttatcctgtttctttgttcctttcgtttgctttcttatttttcttttgttccattcttttcttacttttttcccttttccttttttggggaggctggctagtagtgtgtgagaaaagaatagaagtgaaatttgcataatgaatgtaaaagggaaataaaagtcttttgaaggtagctatactagcacttttgatcatcttcagggcccacaaaaatgttgtcaagattttaaaggtttataattctgcttaagctctagtttggacttaggtatcctaactatgttggaggtatttgcattgtttaaagttaggataaaagcaagttcctcctgtgactgcaacgtcttactgattgggacagttgccaggaggataccaacttgatagcagagggggttttatgcaaacgcactcacctccgccttggggaatgaaagggtcacttctgcatcatcactagctagttttctagtgttagagaggcttacaaatgtttgccattctcataagtgttttgaacttgatctttgtgacttgtgcttttttagcttctctcttgaatcagagtatcattgtcttcctccaaggagttagaatttcccagtttaaaacaaaaagggaaatgtcctaggttttctttgtgcttctcatttttcctttgttgattcaattcctgtgatttttgttctcttccctgaagtgctttacagtgcatggaatctccatcattgttattttaacgatagtaattcacagtcctcagaagcctatttttaaagcagaagcaaaaaagaaaaacaaaataacaaaaacaa

SEQ ID NO: 113375 - DNA, 2210 bp, Homo sapiens
  Payload ID: 2162
  Gene Symbol: CAMK2D
  Gene Name: calcium/calmodulin-dependent protein kinase II delta
  ENST ID: ENST00000511664
  CDS Start-End: 151-1752
gcacactccctcgcgggcgagctactttcggaccaggaaagtaagagcggccctgggtgacagcgccgcggggccagtcccggggttagccgcgcgtctgctcgcttctggtccgtcgcgctcccagccagggcacagcccggaccgaggatggcttcgaccacaacctgcaccaggttcacggacgagtatcagcttttcgaggagcttggaaagggggcattctcagtggtgagaagatgtatgaaaattcctactggacaagaatatgctgccaaaattatcaacaccaaaaagctttctgctagggatcatcagaaactagaaagagaagctagaatctgccgtcttttgaagcaccctaatattgtgcgacttcatgatagcatatcagaagagggctttcactacttggtgtttgatttagttactggaggtgaactgtttgaagacatagtggcaagagaatactacagtgaagctgatgccagtcattgcattcagcagatcctggaggctgtgctacactgccatcagatgggcgtggtccatcgggacctgaagcctgagaatttgcttttagctagcaaatccaagggagcagctgtgaaattggcagactttggcttagccatagaagttcaaggggaccagcaggcgtggtttggttttgctggcacacctggatatctttctccagaagttttacgtaaagatccttatggaaagccagtggatatgtgggcatgtggtgtcattctctatattctacttgtggggtatccacccttctgggatgaagaccaacacagactctatcagcagatcaaggctggagcttatgattttccatcaccagaatgggacacggtgactcctgaagccaaagacctcatcaataaaatgcttactatcaaccctgccaaacgcatcacagcctcagaggcactgaagcacccatggatctgtcaacgttctactgttgcttccatgatgcacagacaggagactgtagactgcttgaagaaatttaatgctagaagaaaactaaagggtgccatcttgacaactatgctggctacaaggaatttctcagcagccaagagtttgttgaagaaaccagatggagtaaagataaacaacaaagccaacgtggtaaccagccccaaagaaaatattcctaccccagcgctggagccccaaactactgtaatccacaaccctgatggaaacaaggagtcaactgagagttcaaatacaacaattgaggatgaagatgtgaaagcacgaaagcaagagattatcaaagtcactgaacaactgatcgaagctatcaacaatggggactttgaagcctacacaaaaatctgtgacccaggccttactgcttttgaacctgaagctttgggtaatttagtggaagggatggattttcaccgattctactttgaaaatgctttgtccaaaagcaataaaccaatccacactattattctaaaccctcatgtacatctggtaggggatgatgccgcctgcatagcatatattaggctcacacagtacatggatggcagtggaatgccaaagacaatgcagtcagaagagactcgtgtgtggcaccgccgggatggaaagtggcagaatgttcattttcatcgctcggggtcaccaacagtacccatcaagccaccctgtattccaaatgggaaagaaaacttctcaggaggcacctctttgtggcaaaacatctaaggcctgaaaaccattcacatatgggtcttctaaatttcaacagtgccacttctgcattctctgttctcaaggcacctggatggtgaccctgggccgtcctctcctcctcttcatgcatgtttctgagtgcatgaagttgtgaaggtcctacatgtaatgcatatgtgatgcatcatcttatcatatattccttcctatacattgtttacacttcaactacggggatgttccacacaaacttaaattactgttggcaaaacaatagggggagattagacaaaaaaaaaaatccacaatattccaagtacaactcttcatcaagtttctctgttaatgccaagatttaacagacttaagaactattgttctctgaatgacagttgtaagagaaatgtaaattttttagaactctttgctgttaatctgttttggtttgtttggttttttttttttttttt

SEQ ID NO: 113376 - DNA, 3563 bp, Homo sapiens
  Payload ID: 2163
  Gene Symbol: CAMK2G
  Gene Name: calcium/calmodulin-dependent protein kinase II gamma
  Uniprot ID: Q13555
  ENST ID: ENST00000351293
  CDS Start-End: 59-1546
ggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 113377 - DNA, 1820 bp, Homo sapiens
  Payload ID: 2163
  Gene Symbol: CAMK2G
  Gene Name: calcium/calmodulin-dependent protein kinase II gamma
  Uniprot ID: Q13555
  ENST ID: ENST00000305762
  CDS Start-End: 1-1590
atggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaa

SEQ ID NO: 113378 - DNA, 3720 bp, Homo sapiens
  Payload ID: 2163
  Gene Symbol: CAMK2G
  Gene Name: calcium/calmodulin-dependent protein kinase II gamma
  Uniprot ID: Q13555
  ENST ID: ENST00000322635
  CDS Start-End: 120-1703
agtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagaaaaggaagtcgagttccagcgtgcacctaatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 113379 - DNA, 3818 bp, Homo sapiens
  Payload ID: 2163
  Gene Symbol: CAMK2G
  Gene Name: calcium/calmodulin-dependent protein kinase II gamma
  Uniprot ID: Q13555
  ENST ID: ENST00000322680
  CDS Start-End: 131-1801
ctccccggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 113380 - DNA, 1822 bp, Homo sapiens
  Payload ID: 2163
  Gene Symbol: CAMK2G
  Gene Name: calcium/calmodulin-dependent protein kinase II gamma
  ENST ID: ENST00000372765
  CDS Start-End: 42-1592
gtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaaggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaa

SEQ ID NO: 113381 - DNA, 3767 bp, Homo sapiens
  Payload ID: 2163
  Gene Symbol: CAMK2G
  Gene Name: calcium/calmodulin-dependent protein kinase II gamma
  ENST ID: ENST00000394762
  CDS Start-End: 131-1750
ctccccggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagttggcaggcagagctccgcccccgcctcgcctgccgcgagcgccgccggcctggccgggcaagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 113382 - DNA, 1618 bp, Homo sapiens
  Payload ID: 2163
  Gene Symbol: CAMK2G
  Gene Name: calcium/calmodulin-dependent protein kinase II gamma
  ENST ID: ENST00000433289
  CDS Start-End: 1-1362
cgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagtgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaa

SEQ ID NO: 113383 - DNA, 1224 bp, Homo sapiens
  Payload ID: 2163
  Gene Symbol: CAMK2G
  Gene Name: calcium/calmodulin-dependent protein kinase II gamma
  ENST ID: ENST00000441192
  CDS Start-End: 1-1006
gtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaagctgccccgctccgcactgggaatggcagctcggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaag

SEQ ID NO: 113384 - DNA, 3824 bp, Homo sapiens
  Payload ID: 2163
  Gene Symbol: CAMK2G
  Gene Name: calcium/calmodulin-dependent protein kinase II gamma
  ENST ID: ENST00000423381
  CDS Start-End: 131-1807
ctccccggtaaagtctcgcggtgctgccgggctcagccccgtctcctcctcttgctccctcggccgggcggcggtgactgtgcaccgacgtcggcgcgggctgcaccgccgcgtccgcccgcccgccagcatggccaccaccgccacctgcacccgtttcaccgacgactaccagctcttcgaggagcttggcaagggtgctttctctgtggtccgcaggtgtgtgaagaaaacctccacgcaggagtacgcagcaaaaatcatcaataccaagaagttgtctgcccgggatcaccagaaactagaacgtgaggctcggatatgtcgacttctgaaacatccaaacatcgtgcgcctccatgacagtatttctgaagaagggtttcactacctcgtgtttgaccttgttaccggcggggagctgtttgaagacattgtggccagagagtactacagtgaagcagatgccagccactgtatacatcagattctggagagtgttaaccacatccaccagcatgacatcgtccacagggacctgaagcctgagaacctgctgctggcgagtaaatgcaagggtgccgccgtcaagctggctgattttggcctagccatcgaagtacagggagagcagcaggcttggtttggttttgctggcaccccaggttacttgtcccctgaggtcttgaggaaagatccctatggaaaacctgtggatatctgggcctgcggggtcatcctgtatatcctcctggtgggctatcctcccttctgggatgaggatcagcacaagctgtatcagcagatcaaggctggagcctatgatttcccatcaccagaatgggacacggtaactcctgaagccaagaacttgatcaaccagatgctgaccataaacccagcaaagcgcatcacggctgaccaggctctcaagcacccgtgggtctgtcaacgatccacggtggcatccatgatgcatcgtcaggagactgtggagtgtttgcgcaagttcaatgcccggagaaaactgaagggtgccatcctcacgaccatgcttgtctccaggaacttctcagctgccaaaagcctattgaacaagaagtcggatggcggtgtcaagaaaaggaagtcgagttccagcgtgcacctaatgccacagagcaacaacaaaaacagtctcgtaagcccagcccaagagcccgcgcccttgcagacggccatggagccacaaaccactgtggtacacaacgctacagatgggatcaagggctccacagagagctgcaacaccaccacagaagatgaggacctcaaaggtagggtgcctgaaggacggagctcccgggacagaacagccccctctgcaggcatgcagccccagccttctctctgctcctcagccatgcgaaaacaggagatcattaagattacagaacagctgattgaagccatcaacaatggggactttgaggcctacacgaagatttgtgatccaggcctcacttcctttgagcctgaggcccttggtaacctcgtggaggggatggatttccataagttttactttgagaatctcctgtccaagaacagcaagcctatccataccaccatcctaaacccacacgtccacgtgattggggaggacgcagcgtgcatcgcctacatccgcctcacccagtacatcgacgggcagggtcggcctcgcaccagccagtcagaagagacccgggtctggcaccgtcgggatggcaagtggctcaatgtccactatcactgctcaggggcccctgccgcaccgctgcagtgagctcagccacaggggctttaggagattccagccggaggtccaaccttcgcagccagtggctctggagggcctgagtgacagcggcagtcctgtttgtttgaggtttaaaacaattcaattacaaaagcggcagcagccaatgcacgcccctgcatgcagccctcccgcccgcccttcgtgtctgtctctgctgtaccgaggtgttttttacatttaagaaaaaaaaaaaagaaaaaaagattgtttaaaaaaaaaaggaatccataccatgatgcgttttaaaaccaccgacagcccttgggttggcaagaaggcaggagtatgtatgaggtccatcctggcatgagcagtggctcacccaccggccttgaagaggtgagcttggcctctctggtccccatggacttagggggaccaggcaagaactctgacagagctttgggggccgtgatgtgattgcagctcctgaggtggcctgcttaccccaggtctaggaatgaacttctttggaacttgcataggcgcctagaatggggctgatgagaacatcgtgaccatcagacctacttgggagagaacgcagagctcccagcctgctgtggaggcagctgagaagtggtggcctcaggactgagagcccggacgttgctgtactgtcttgtttagtgtagaagggaagagaattggtgctgcagaagtgtacccgccatgaagccgatgagaaacctcgtgttagtctgacatgcactcactcatccatttctataggatgcacaatgcatgtgggccctaatattgaggccttatccctgcagctaggagggggaggggttgttgctgctttgcttcgtgttttcttctaacctggcaaggagagagccaggccctggtcagggctcccgtgccgcctttggcggttctgtttctgtgctgatctggaccatctttgtcttgccttttcacggtagtggtccccatgctgaccctcatctgggcctgggccctctgccaagtgcccctgtgggatgggaggagtgaggcagtgggagaagaggtggtggtcgtttctatgcattcaggctgcctttggggctgcctcccttcttattcttccttgctgcacgtccatctcttttcctgtctttgagattgacctgactgctctggcaagaagaagaggtgtccttacagaggcctctttactgaccaactgaagtatagacttactgctggacaatctgcatgggcatcacccctccccgcatgtaacccaaaagaggtgtccagagccaaggcttctaccttcattgtccctctctgtgctcaaggagttccattccaggaggaagagatctataccctaagcagatagcaaagaagataatggaggagcaattggtcatggccttggtttccctcaaaacaacgctgcagatttatctgcacaaacatctccacttttgggggaaaggtgggtagattccagttccctggactaccttcaggaggcacgagagctgggagaagaggcaaagctacaggtttacttgggagccagctgagaagagagcagactcacaggtgctggtgcttggatttagccaggctcctccgagcacctcatgcatgtcccagcccctgggccctagccctttcctgccctgcagtctgcagtgccagcacgcaaatcccttcaccacagggtttcgttttgctggcttgaagacaaatggtcttagaattcattgagacccatagcttcatatggctgctccagccccacttcttagcattcttactcctcttctggggctaatgtcagcatctatagacaatagactattaaaaaatcaccttttaaacaagaaacggaaggcatttgatgcagaatttttgcatgacaacatagaaataatttaaaaatagtgtttgttctgaatgttggtagacccttcatagctttgttacaatgaaaccttgaactgaaaatatttaataaaataacctttaaacagtc

SEQ ID NO: 113385 - DNA, 2336 bp, Homo sapiens
  Payload ID: 2164
  Gene Symbol: CAMK2N1
  Gene Name: calcium/calmodulin-dependent protein kinase II inhibitor 1
  Uniprot ID: Q7Z7J9
  ENST ID: ENST00000375078
  CDS Start-End: 842-1078
cgcggccggcatttctcctcgcagctcgctgcctcctctatccctgcctccctctcccccctctgtttttctcccttccttccctctccgaccctcttcctctccctcccgatcctttccctcctcctctcatctttcccctgtctctccgttctagctcgtcccccaccccaccttttcttctttctcctcctctccttcctctccccctctcctctgtctccttccaccgtctcccctgcctccctgtctttcagtccctgtttttcagccccgtctccctctcggtttctctcccccaccctccctccgggtttcctccccggtgccctccctcctctctccctcccctccccctccgcccctcgcagccccgccgctcgcagctcccagtctgcctccccgaaccggcgccgccgcccgcactcgccgcaggaccggcccgcccggctcccggggtgcgccctcctcggtcccgcgccctccgggctcgcagggacgtctcctccctcccggctcgcggccccgcccggcccggcccccgcccagagccccagcgcgccgaggatgtgagtcctgctcgcctctggcggagcagcagccactcgcgcgcggagccggagcgcagcgcagcgcagccgcgggcgctctccgggccgctcgcgcgagtgccgcgctcttgccctagcggcgtcccccggcctctcgccggcgccaccgccgcagcagcccgcgggccgtccccggccggccgcccccggccccagcgccgctgaccctgtccgccgcgggcggggacgcgggcggaggaggcgccgcggcggagcccccggacgcgaccatgtcggaggtgctgccctacggcgacgagaagctgagcccctacggcgacggcggcgacgtgggccagatcttctcctgccgcctgcaggacaccaacaacttcttcggcgccgggcagaacaagcggccgcccaagctgggccagatcggccggagcaagcgggttgttattgaagatgataggattgatgacgtgctgaaaaatatgaccgacaaggcacctcctggtgtctaactcccccaaagacaatgagttaagggagagaataagaacggcggtaacagttattggcaaaaagcatgaaaagagaaagcactttgaaatttattactagcttgctacccacgatgaaatcaacaacctgtatctggtatcaggccgggagacagatgaggcgagaggaggaggaggaggaggagaaggctctgggctcctctgcaaaaataaaaataaaaaaataaataaaattttaaaaataataaaaattcactatatacacatataaagaaataaaaagaagtctcagttgcagctatttgtcaaaattaatatccatttctttttatatacggtgaatattgcgcaattatagatctggattttgaaccacttaatgaagcggcaacaccaggtgttttgaggtgttggcattcttcgctgatttggctgttcccaatgtttacattatttaatcttgcaaaaatggttctgtgcacttggatgtgaaatgctgtccagttttattttttttatgttgttatccttggatgtacaaaaaattcagaaaatgatctctgtagatattctgttttattttggtcatctttagaagttatcaggaatgtgtttaaaacaagaagagaacttttctaaggaatgatacatagaaaagattttattttaaaatgagttgtaaagcttgtgtttctttgttgctgcaagctatctgcccaagttaatgcaaatggacacattttttatgtcagaaaaacacacacacacacacacacacacacacacacacacgaaaaacaaagaaaaaaatgcttgagctttttctaacttccccttgcagtctgttgtgtgagcagcctgtttatttctctaatattatgtcagtttattctctttaatggactgtaaaaaaatgtaatcacaagagtgccaaatatcttgaaatgccaaaaggcattttagtttcttttctctgtgctctgagtccacgtacaggaatgcttggagtgtcttttctgttatttatagggattctcttaaggcacaccagctgcctgttttgcatggtatttgcaaaaatgcctcttgcgtgaggaaatcttttaccattttttgtttgcaactttggacctcaagaggtttcccttcccttccccgttccctcttttcttaattcaatattctgtatgttgcaccttgaaccagcacacagggctatttctccaatgtacaataaaagaattgttcctgtgtctca

SEQ ID NO: 113386 - DNA, 1362 bp, Homo sapiens
  Payload ID: 2165
  Gene Symbol: CAMK2N2
  Gene Name: calcium/calmodulin-dependent protein kinase II inhibitor 2
  Uniprot ID: Q96S95
  ENST ID: ENST00000296238
  CDS Start-End: 179-418
cggcccgggaggcggaggcgcgggggaggaggccccgcttggctcctcagccccggatgctgcatgacttcatccttccgccggctcccctgctgaggtagggccggtccggcagcaagcccgccgcccgcgccccgccgcagtcccgctcccgccccgcgcccaccccgcgcccgccatgtccgagatcctgccctacagcgaagacaagatgggccgcttcggcgcagaccccgagggctccgacctctccttcagctgccgcctgcaggacaccaactccttcttcgcgggcaaccaggccaagcgaccccccaagctgggccagatcggccgagccaagcgagtggtgatcgaggatgaccggatagacgacgtgctgaaggggatgggggagaagccgccgtccggagtgtagacgcgccggctcgggcggcgggctccgggcccagcctcgcagcggccaggagcgcgggccggcgatgcggctgccggcgcccccccgccccggcccaggcgcccgcgggcgggggctgcagggccgtgccgccgccgccgccaggcactccggagctgtccgcttcagcaccacggcggccgcggtagcggcggcgcggacccgcccggaacccgccgccgcgctcatgcactttaaaacctcgggccgcagccccaccccgcacaccggaacggacacggagacccgcggcccccagcccccggcccgccccctcccgcacggctcccctgccccgcccccctccggccagtctggtctgcagaccgggcggccgccggtgtcggaccgcgcgcggccagggatgtttggctgcgtacttgcatgagctttccacccacttgagcccagtcctccgggccgttcctcgcccccacccctgtctggcgtgaccccagcctcagcctctttctaagggacttcctcagcacatttgtatttttatatccgactctttgtttactggctctgctcatggttcctgccctcccctcagtctcggccacgctcttctgcgcctggcagataggatgggtgttgaggctgggatgagacaagcccccgacacggttaccaaccacatggccagtctgcccaggcctgaccccaggaggctttctggcagaccccttctccccaaggtatcatcaccttccaagggcccagatccgattttaccttggacccctgcgtcttgcccctgggaacccaaatggggactgctctgaacctttggatgacatctgtggccccggagatgttctcaacccaggggtgcccttcgtaaatgttcctccatcctcactgtaccaggagtgtgtgaataaacacagaccccctctgtg

SEQ ID NO: 113387 - DNA, 12240 bp, Homo sapiens
  Payload ID: 2166
  Gene Symbol: CAMK4
  Gene Name: calcium/calmodulin-dependent protein kinase IV
  Uniprot ID: Q16566
  ENST ID: ENST00000282356
  CDS Start-End: 399-1820
aagctccagcatccggagccgccctagccggcaccgcggcagccacagcctgggagagagaaaggaaagagggagggcggcgggaaaggctcggcgcgggaggagggcgggtgaggagggaaggagcgagggggagggagcctctctcctcagcggtgcagctagtctccctccagcgggcggcgactccgggttccccctcgcgccctctcgcagaggctcgcccccttccccgcccaccgtccctgcgagcgcgggcggcggcggtgggcgtgtgcgcgcgtgaaggacgccgcctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaatagtagcaaattgtttttgctttgaaaatctagccatcctacatcctttggatttcttcacaaggcagtaattcctttgaactactgcttagctaatactaggtagtgctaaaagacatgttcccataacttttacaacattttactttttatcattgatgtgttcaaactgtttacaaggagatgcttatagatgatagttgtacatatgtgcaaaaaaaaatccacttgcaatggtaagaaattgaagtatccttaaaggccatgaagccatatgtccctaaagcctgtgtggagaatgctttattttattcttatttatatacactatattaataataaccaaaatgttctaagattctgccattttacaaccctggaggaagtaatttacaaactcacgctgagttccattctttccttcacctgctctccaataagatgactttctgatagacaaagcttagggtgtaataaacagggaagaaaagaaggtaagactgtacttaaactgatgaagataagattgattccttttcattttccagataaaattgtatttactcatgaatttatacaactttacagataagaacattttaatggataaactctataattaccaagttgcaaatatttagaaaattctatttcacaggttagtgccaaaatgtcttcatagagtaggaataatattccattttaagattattcattattgactttaatagagtaagaaaacattattgtttatcaaagctctttttttatccaattgatggttatctacacatatcacttataaactaaagttatttatgaaaagctagtatgtctttttctcgtatttggaatgaaagtacccacattttacaatgtagtgttgagaatgtggctgccaataaatttagcacaatgcaatttatttaccttaaaaaacaaacaaaaacaaaaataaagaaaaatactgatttcaaatcagactcttaaaaagctggaacattagacctgatattttattatgatttttcccagaataagtttaatttctctttgactttcatagaaacactttccccttatagaaattgcactatctccaatttatttctagtttgagttgaaatgaatattttatcagattaattatgtgtcacatttttggtgggttttctcaattttaaaaaagaattcattttaaaaaataattattttcagagaccaaataaagacaataaaaatgactatcacataaaaatccttgttaaaaaagagatcttaaattatgttggctctccctcaaaactattaaattagaaaacgaaactaaagctccagtttgtagaggctgttggacctcagtagacattcttcttttcaatcacaaatctctctctactactgttctcatgggaagaaaacaaggtaggacttcttatctttcatagtttaagaatctgacaggtcactgatatggagcccctgaagaagcacatcatctgggctcagaagattattttttgttttgttttatttgtactatctagtagagagcacttttcttattccctctttccttccttcctcatttaattattccctctcagaattcccatgttgtccattataaggggctcgctatttttaacctttaagaatgtcttctttgttaagcattaagatttccatttaagaggatcaatttcctgttgtactttttaccatgagactgaaacacacacacacacacacacacacacacacacacacacacacgtgttggaagagcaaagagagggaagggggtctttttagaaagtggcacttggcgcttagctgaaagatcagaacacatcattcctccctgcccacccccatattgttccaagggcagttgttacattatttcaacactagagtagggcggactgcattgtttggccctgagaactatagaaacaacgttgcaaataccatgcccaatgtgtattttagaatttactcatttaaatgagtgcatattaccattcctccatgtgagtactcgagttgataattccctctatctttttaaacccataaactacatttttaaaaaaatcaatgggagttttaaattttgactcatgttaaagataagattctgataatgactatatagtgactaatttcattgtttcagtaggaaacaaatcaaactttcaaaaatgttggtcatttcagtcaaattattcaaagatttcatatacatacatcctaagttaggataattatgttaacatttttgaaagaacagccaatgtttatattgcttgttaaaatggaatgtattgtctatctcaaagattacttagctaaataatagtagacaaatggagatttaatttcacaaaatacttcataacatcactcctaattggcaatatagtcacaaagcaaaagaattcaaatttcagcaaacaataaattacattttacattttagagctaacacttatcacattacattatgggtttttattttgagataagttcagctacatagcataaactaggtttttttttataaccatgaaggacagtcttgaattatttcccccattaacaaagtctaattggaatccagtattttttctcaaactgtaatttcacttgtcccaggacacataaataggtaaaaattagaataatatcgtggtagaagttaattgtccagaacaagtgcattatataaatataatgcaagcacatgtcatttaagattttctattagtcacattttaagaaaaatagatgaaagtatagtatttttaatccaattcatccaaattattctatcgatatatagtcaatattaaaatttaatgtgatattttgaattctttatttttatactgttttcaaaatcaagagtgtatgttaggcctttgggacatcaagtgctcaatagtcacatgtggctagtggctaccatattagacagcactagtctagagtactttttattttaagcaaagtgacacttgaagttctatgcttagatttaagtggcctcagttttcacattgaggagctggtgggaggccacaaagaaagtgtttcagaaatgttacacactgagtaaaagcttattgaccactcctgcccattcatttacttcagaggagaaatgattcctaacatgacttcaaagaacgggcattactaaattatctactgaccaatccctctgattcctgatgggccctggagtcttgactacagcctagagtctcctgagtactgccatgatgccaatagcattcttgcttaccaaaatctactctcagccaactatgtgtcttcattcaggaagaactgcacatagaatctgattttgaggcctggattaagcttcatgccatccttgtatcacaggcaatatgtctttctggaaatctaatgaaccataccaaatctgcatgatgaagattgtgtaatgatggtgatatcatgccagttatcctcaaagtgggaatatgaccattagctggcattttttaagatttccttagaagggtttaatcaacactgccattacacatggatttaacaaaagacttttgaaaattttttacatactgattttagaataatcctcaaggttctatagtcatttttagtggaagacttaaaaagaaaggaacaatttttactgtgacttcaatttcatagtattttaaacatattttgtaattcagaatgtttagcaatccctatgtcctgtttcacatgcatggtaactgatggtgggttgcctacaggctgaagatttggagagagccattttgtttcataaatcagtttttattgcacagaagcagctggttgtatttcaagttggaaaaagaaaagtaaatgccagaaaaggcaaaggataaacttagtaagccatttattttgttttagaattgtttttgcaaagcaaatttttttaaaaaaaggtcaacaaagtgaatcagcactagcattttcttgatggttgactcaatgtataattaacaaatatacatagcagagtcaattaatcatagtgccattatgtcacttatttgtcattgcaaagtattcagtcatgttgtctagatttactttagatggtgcaaaatttccagatagtaacctatgtaaaaggatttgtaatttccttgtaattcctgcctattagtccatattctgatttccttatgttcatcactgatatgttcctgatcagggtcattgctagtagttgagcatttactggttgaacattgtttaatggttagatgttatgtgtgtctgcatttaaaaaaattgtgtacatgttatttcactattggtattacaatattcataaccacatgataaacagaaatgtacccaataatttcctataaaatttttcaaagtccttttattcccctgacacactcagggtgaatttttgtctccttggcaaataagaaaaaaaaggagagagaccactggagagatatcagcaaaccacccacagtaaccaagttcagtatttcctctttctatattttgaccaatatattaagagcaaattttgtcattattactccttgtggctattacctgagatcagataatataatctcagctcataaagcttggccatgtctatacttatcttggagagcaataacaaacttgattaatttgtttggttatttaaaattccaactttcataaatgctctgtgatgtactcaagacgattgggttgtgtgatactaacttccttcaagaactcagtctgttccctgttgtctggttcagaggtccaccagggcaaaatagaagccttgccgagaaagtgaactgtcttactccttcaaaggaatcagatgttgctctagagaagactccaggcatctacctggttgagctcaaatgaggcaagtgggagaaaacctcttctcatcctctgattgaaagtgatacaatttgaatattggtatattgtcattggtcagtaatggaaaaatgagattccaccagtgggttactcttttcttgtcttggtttgctatgccttatcccagatcagtgttttgttccatccctatggtcatctctaaagccctgacaggagcatcccagactggagaaatgcagcgtatctgtggcccagaattttgtttgatactctaaacagcaatgcaaagactgcaaaatcacactattctaaacagttgttttcagctcattttgaagattgacctggaaaacatatagatacagaatatatacatttaatcgttgcttgtgattcattgtgtcaaaataacatttaattttcactctgattaatctttattttccatttaaaagattatttcaggctacttaaatacaagaccttgcattctaatttttgaaagcggttgttttccctgagctctctctcaactttgacagtttgtgaatgataaaaagttactaggtttgtcctttccttgatagatgtagagcagttcatctgttttgtaaaggtacagttaagcataactataggctgggcgtgatagttcatgcctgtaatcccaacactttgggaggccgaggttggcagatcacctgaggtcaggagtttgagaccagcctggccaacgtggtgaaacccctaatacaaaaattagctgggcatggtggcacgctcctgtaatctcagctactcaggaggctgaggcaggagaatctcttgaacccgggaggcagaggttgcagtgagccaagatcatgccactgcactccagcctggacaacaagagcgaaactccgtcaaaaaaaaatatatatatatgaccataaattgaaaactatcatctcatactgcctccttttaacctgacctattttatatacctacaatacagttaatatgcagcagcgtagagaacaaatagcatattcataatttgtaattttgtttttctttttacggcacccttaagtctcagtaatattttaaaagtcctctataagccaaaagaacgttgtaacatatccatttattaaggagttaggcctaaacatagtaatagtagtccattccatgtccaacagatgttgctgtgtttctttcaacatttttcaatgtcttgtgagtttagtgagtgggtacagctgagttggggtttaggtgatttcttatgcccaatgaactaaaggtatcagtaaaagattattagtaaacaaattagttatttatgctcttacttgaatgtcagtcattcattttatctctcgtctttgagatacacacattaaaacttatgtgcatatttttttaaagagtaatttccacataattccccaagaactgaactcaaatctccaaaaatttttcagaactcaagcaaccaatgattcacagagcaaatctaccaaagccccatttttattggaacacaggcatgctcatttatgtacatattgtttgtggctgcttttatgttgtcaaggcagagttgagtactttcaacagagaccatatggactgcaaagcctaaaatgtgtatctggacccttacagtaaaacaatgaccctgggttttcatggcaccccaatgcctttttggtgacttgcaggaatacagattcctatattccagtttgtttttttttttttctccttagcttaaggttcgtattcccatttgcttctgagaaagttaggaaaattttgttttatgttgcagatgctctcacaacaataattgtgctggagatagatacaacttagtgaaattttcctacagaactaaaaacgcaaaattgcatcactcctgaagaaaagaaatttagagtatgaattgagttggttgagagtagaattaaaaagatttctagcactttgagcatgttttagaaatttgatccttacatttaaaattatgtaaatgacatctttcactggcatttgctcacatttaagtcaatctacagctgttacttactaagctaagaaataagaagatccctatggttctgaatctctcataatattctgaagtaatttatatcaattgaattttcattaatcattttaggaaatattatgttttattttgtggcattatatgacaatgactttctcaacaatagctcagggaatacgcaaacagccagctcttttatgtaagaaagccattttctaatccccacgctttcctgagtgttacgtattttatttctttgaaaagagagggccttgagtaaatgctttcgtttgctttccttacatatttagaaatccaagaagggcccttgtcttagtctatttctgtcacagagaaattgttcattccaaaatatccaccttaagggaagctagtgaccgagatatggagaaaaacataggcattcatgacctttgtgtttccgtttgactttcaacatctgtaaccaaaaggtcacaaatgaaatatttagtagaaagtgcaatatcaatttattaggagtacctaaaattataactctaaataatatacagcaatattattgctctattattacagcaatcaataatataatatagccactaggatacactcgctgtagaactcagaacaaaagatatcaatcttctgccagtccgcatcattatgtgtagcagagactttactggaatgagtgaggggaaagataacaaaatgtagattaggattccacattctcccctgcccatcttcttgattgctcagtttgaagacgatcattgatggacaaatactttagaaatgaatgaagtcaatagctaatgtttctcccagaaactaaacaacatagtttaggggatattaggcctacattctaatcacattgtaaggaagtgattttctaattttgaagcttcccaggagcagccccctccaggaacaattttccctgtgaactttcactgagaaactattatatgccatggaggagtcaaagatgaattaaatccaatgctatcctccaggagtgagctttgtagttggagagaaaagccaaccttatagatacaacctgtacatatataacctatgctgcatttaggcagatgataagccctaggaatggaaagagggaaaagctcccttttgccaggaatgatgaaggaaagctttatggaaacacaggctgtatgtgaaagatgggtgaatctttgcaggtagggaagaagtagggggcatgtctggctgagaaccggcctgatcatagagtggaaaaatgaaaggcagaggtgaaggaagaatactaaatgtgaaaggctgaaatacacagggaagtgttgccagtgtgcaacagaatctcatctcgtgcaaaattgaattagacttccttactccttccttactctgggtaggtccatgtgcagcctttcctcagagcatctagcctgacatacttggctcatctgctgtgcttctaagccaaataaaaatcatcaaacacatcgaagatatttttgggagtcaccaggttaaagcaaagcctcagtcactgaaagcaaaaactgaattggccaggtctccactgacaaaacagagtaaatgatagtatgacagataatttcaagttttccaagactccaatttctgaaaaatgtctcatgactccaaaaaatcacgtacttcctaaaatgttgccagtggaggaccgaatcaaggttattgctgacctcattttttcaaccttttcagttatttgacctgaataggcaatcccccaggatttctgattgaattctacctgaaagtttagattttaaaagacaacctgtaggaagctaagtctcaggcaacaaaatttaaaaccatcagaacttgtttctccaaacatcaacctgctcctgtcaagtcctttttcatctctcccttttgtccctttacatactgttttgtaagttccttttgatatcatttattgcaggcagtatttttacatccatcttcaagaaacttgggagacatttagacatttagtatgtgtacttttagttgtcttgcctctttatttcagataatgcctgtgattagtgaatggcggcattattcctgaagacaaatgaaggaagatagggagcaagattgactgtcatttgaatgatggaagagaagtagaattactgtgaggttacaaaaatcgtaagttagcagacattgagaaaggaaaacttcctacttgggcttttcaggcttatgtgacattatctggatgtgttttctagtctttcctaaaggagaaatttttattcctgggttgctgaaagctttctggactaaaaggatataagcagctcaatagcagcatagaggattagattaatggaacagcactgcatacaggaaagctacatctccaatagtttaggctgcaagtcagtagccaaacacaagagcatgtaagatttggaggacaaagtataaatattttaagtttacacaaccaagattataggctaccttcccaacttctaatttgaagagcactgaaaatggagctgtgaacacttcatttttaaaacctgacaatatggtgctattgactacttaatacaaagatatattacaatatttttaggtaaatgtattaagtctggcctgggcataaatgtacatacagaaaatgtttgtagagaattcatcaaaatcatgcccatttgctgttgtagagctacagtattcttcaatggtggtgactgaccagtgagtttctacttcttacagatgggacacaacagtcatgggctgtctcagctgcccaaagcctgaggcagaccacatgagagctgtggcttcttcttggattcaggttggataacccaattcagtaattaaatatgtaaattttggggggggttggggggtgttttctaggaacttgaagagtacgtgacattataaaaaatgggtgttggaagactaattgtagaaatttgacctgagggccaatgttacttggtgtaagttcactcagacagacatgtcagaacatgcccaaagaagcctatatcttgctgctgggaaatgtaaagcagttggcatgtagaatacgataataaatcatttaagaaaccaccaaaa

SEQ ID NO: 113388 - DNA, 852 bp, Homo sapiens
  Payload ID: 2166
  Gene Symbol: CAMK4
  Gene Name: calcium/calmodulin-dependent protein kinase IV
  ENST ID: ENST00000514007
  CDS Start-End: 76-405
ggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattgattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaa

SEQ ID NO: 113389 - DNA, 1640 bp, Homo sapiens
  Payload ID: 2166
  Gene Symbol: CAMK4
  Gene Name: calcium/calmodulin-dependent protein kinase IV
  Uniprot ID: Q16566
  ENST ID: ENST00000512453
  CDS Start-End: 100-1521
cccggacccaggtgctgccagggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaac

SEQ ID NO: 113390 - DNA, 571 bp, Homo sapiens
  Payload ID: 2166
  Gene Symbol: CAMK4
  Gene Name: calcium/calmodulin-dependent protein kinase IV
  ENST ID: ENST00000504544
  CDS Start-End: 103-369
ctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaacccca

SEQ ID NO: 113391 - DNA, 1678 bp, Homo sapiens
  Payload ID: 2166
  Gene Symbol: CAMK4
  Gene Name: calcium/calmodulin-dependent protein kinase IV
  ENST ID: ENST00000515231
  CDS Start-End: 103-369
ctctctctcgctcctgcgttcgcaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagattgtggaaaagggatattacagtgagcgagatgctgcagatgccgttaaacaaatcctggaggcagttgcttatctacatgaaaatgggattgtccatcgtgatctcaaaccagagaatcttctttatgcaactccagccccagatgcaccactcaaaatcgctgattttggactctctaaaattgtggaacatcaagtgctcatgaagacagtatgtggaaccccagggtactgcgcacctgaaattcttagaggttgtgcctatggacctgaggtggacatgtggtctgtaggaataatcacctacatcttactttgtggatttgaaccattctatgatgaaagaggcgatcagttcatgttcaggagaattctgaattgtgaatattactttatctccccctggtgggatgaagtatctctaaatgccaaggacttggtcagaaaattaattgttttggatccaaagaaacggctgactacatttcaagctctccagcatccgtgggtcacaggtaaagcagccaattttgtacacatggataccgctcaaaagaagctccaagaattcaatgcccggcgtaagcttaaggcagcggtgaaggctgtggtggcctcttcgcgcctgggaagtgccagcagcagccatggcagcatccaggagagccacaaggctagccgagacccttctccaatccaagatggcaacgaggacatgaaagctattccagaaggagagaaaattcaaggcgatggggcccaagccgcagttaagggggcacaggctgagctgatgaaggtgcaagccttagagaaagttaaaggtgcagatataaatgctgaagaggcccccaaaatggtgcccaaggcagtggaggatgggataaaggtggctgacctggaactagaggagggcctagcagaggagaagctgaagactgtggaggaggcagcagctcccagagaagggcaaggaagctctgctgtgggttttgaagttccacagcaagatgtgatcctgccagagtactaaacagcttccttcagatctggaagccaaacaccggcattttatgtactttgtccttcagcaagaaaggtgtggaagcatgatatgtactatagtgattctgtttttgaggtgcaaaaaacatacatatataccagttggtaattctaacttcaatgcatgtgactgctttatgaaaataatagtgtcttctatggcatgtaatggatacctaataccgatgagttaaatcttgcaagttaacacaacgtaacacttaaaagcatacattttcagcaaccagtggcacatatttgaagtgaa

SEQ ID NO: 113392 - DNA, 557 bp, Homo sapiens
  Payload ID: 2166
  Gene Symbol: CAMK4
  Gene Name: calcium/calmodulin-dependent protein kinase IV
  ENST ID: ENST00000508074
  CDS Start-End: 132-557
agtgccaccagcagcgacgacagcatttattccaactgaagacttcactcaaaggcggcggctggcggccggcttctcgctcgggcagcggcggcggcggcggcggcggcttccggagtcccgctgcgaagatgctcaaagtcacggtgccctcctgctccgcctcgtcctgctcttcggtcaccgccagtgcggccccggggaccgcgagcctcgtcccggattactggatcgacggctccaacagggatgcgctgagcgatttcttcgaggtggagtcggagctgggacggggtgctacatccattgtgtacagatgcaaacagaaggggacccagaagccttatgctctcaaagtgttaaagaaaacagtggacaaaaaaatcgtaagaactgagataggagttcttcttcgcctctcacatccaaacattataaaacttaaagagatatttgaaacccctacagaaatcagtctggtcctagaactcgtcacaggaggagaactgtttgataggattgtggaaaagggatattacagtgagcgagatgctgca

SEQ ID NO: 113393 - DNA, 2459 bp, Homo sapiens
  Payload ID: 2167
  Gene Symbol: CAMKK1
  Gene Name: calcium/calmodulin-dependent protein kinase kinase 1, alpha
  Uniprot ID: Q8N5S9
  ENST ID: ENST00000158166
  CDS Start-End: 150-1712
tctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggccctgcagaaccaggcccagaatatccagttagattcaacaaatatcgccaagccccactccctgcttccctctgagcagcaagacagtggatccacgtgggctgcgcgctcagtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgtaagtactggtgggccagggactgccgggcactccctggagttgggtggggaggtctgaggcccatcctcccactctcactgtcgttgggccaaggccagagcctggggacttggccaggtctcggtgttggccccatttgcatctctgtccccaaggttagtcggggctagaagggaccttttgggcccagctcttgcttcattcctggggccagcatccctcacacacacacttccagggatgaggagctcacgcagcccctccatgggacaggaagacccttcttccatgcagcttgatgtcactctctcactgggtccagcccctctggggcttcaaatctgtggccccctcagcccttggcagcctggcagaggtttgcagacaggctgatgttggcttcctgtaggaggctggcgggctgtagaggaggggtgctggcccctctgcctggccctggggactgttggctgctctcccaagtggcccaggctgcctgcagccattgctggggctctgtgcccagtcagcactttgtgagtgcttgttcagtgagtaagcagggacaggctggccggtggaccacgggagaggaacccgcattggccgagggctccctatggtgagccacgcctgtgggttcaccacctcctaggagggtccagaaaagcagctccccaagcctgtgcgcctcgtcctcagcagatccaccttcttcactataataaaagccagtctgggatgctaa

SEQ ID NO: 113394 - DNA, 3563 bp, Homo sapiens
  Payload ID: 2167
  Gene Symbol: CAMKK1
  Gene Name: calcium/calmodulin-dependent protein kinase kinase 1, alpha
  Uniprot ID: Q8N5S9
  ENST ID: ENST00000348335
  CDS Start-End: 150-1667
tctgggccccagcgaggcggtggggcggggcggggcggggcggggcgcgcagcaggagcgagtggggccgcccgccgggccgcggacactgtcgcccggcgcccaggttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggacctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaagcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaaaaaaaa

SEQ ID NO: 113395 - DNA, 3508 bp, Homo sapiens
  Payload ID: 2167
  Gene Symbol: CAMKK1
  Gene Name: calcium/calmodulin-dependent protein kinase kinase 1, alpha
  ENST ID: ENST00000381769
  CDS Start-End: 14-1612
agcagaacagagtatgcaatttgggaagctgtggtgtggctgcagtggagagttcccaacaaggctacgcagaagaacccccttgactgaagcaatggaggggggtccagctgtctgctgccaggatcctcgggcagagctggtagaacgggtggcagccatcgatgtgactcacttggaggaggcagatggtggcccagagcctactagaaacggtgtggaccccccaccacgggccagagctgcctctgtgatccctggcagtacttcaagactgctcccagcccggcctagcctctcagccaggaagctttccctacaggagcggccagcaggaagctatctggaggcgcaggctgggccttatgccacggggcctgccagccacatctccccccgggcctggcggaggcccaccatcgagtcccaccacgtggccatctcagatgcagaggactgcgtgcagctgaaccagtacaagctgcagagtgagattggcaagggtgcctacggtgtggtgaggctggcctacaacgaaagtgaagacagacactatgcaatgaaagtcctttccaaaaagaagttactgaagcagtatggctttccacgtcgccctcccccgagagggtcccaggctgcccagggaggaccagccaagcagctgctgcccctggagcgggtgtaccaggagattgccatcctgaagaagctggaccacgtgaatgtggtcaaactgatcgaggtcctggatgacccagctgaggacaacctctatttggtgtttgacctcctgagaaaggggcccgtcatggaagtgccctgtgacaagcccttctcggaggagcaagctcgcctctacctgcgggacgtcatcctgggcctcgagtacttgcactgccagaagatcgtccacagggacatcaagccatccaacctgctcctgggggatgatgggcacgtgaagatcgccgactttggcgtcagcaaccagtttgaggggaacgacgctcagctgtccagcacggcgggaaccccagcattcatggcccccgaggccatttctgattccggccagagcttcagtgggaaggccttggatgtatgggccactggcgtcacgttgtactgctttgtctatgggaagtgcccattcatcgacgatttcatcctggccctccacaggaagatcaagaatgagcccgtggtgtttcctgaggagccagaaatcagcgaggagctcaaggacctgatcctgaagatgttagacaagaatcccgagacgagaattggggtgccagacatcaagttgcacccttgggtgaccaagaacggggaggagccccttccttcggaggaggagcactgcagcgtggtggaggtgacagaggaggaggttaagaactcagtcaggctcatccccagctggaccacggtgatcctggtgaagtccatgctgaggaagcgttcctttgggaacccgtttgagccccaagcacggagggaagagcgatccatgtctgctccaggaaacctactggtgaaagaagggtttggtgaagggggcaagagcccagagctccccggcgtccaggaagacgaggctgcatcctgagcccctgcatgcacccagggccacccggcagcacactcatcccgcgcctccagaggcccacccctcatgcaacagccgcccccgcaggcagggggctggggactgcagccccactcccgcccctcccccatcgtgctgcatgacctccacgcacgcacgtccagggacagactggaatgtatgtcatttggggtcttgggggcagggctcccacgaggccatcctcctcttcttggacctccttggcctgacccattctgtggggaaaccgggtgcccatggagcctcagaaatgccacccggctggttggcatggcctggggcaggaggcagaggcaggagaccaagatggcaggtggaggccaggcttaccacaacggaagagacctcccgctggggccgggcaggcctggctcagctgccacaggcatatggtggagaggggggtaccctgcccaccttggggtggtggcaccagagctcttgtctattcagacgctggtatgggggctcggacccctcactggggacagggccagtgttggagaattctgattccttttttgttgtcttttacttttgtttttaacctgggggttcggggagaggccctgcttgggaacatctcacgagctttcctacatcttccgtggttcccagcacagcccaagattatttggcagccaagtggatggaactaactttcctggactgtgtttcgcattcggcgttatctggaaagtggactgaacggaatcaagctctgagcagaggcctgaagcggaagcaccacatcgtccctgcccatctcactctctcccttgatgatgcccctagagctgaggctggagaagacaccagggctgactttgaccgagggccatggacgcgacaggcctgtggccctgcgcatgctgaaataactggaacccagcctctcctcctacaccggcctacccatctgggcccaagagctgcactcacactcctacaacgaaggacaaactgtccaggtcggagggatcacgagacacagaacctggaggggtgtgcacgctggcaggtggcctctgcggcaattgcctcaccctgaggacatcagcagtcagcctgctcagagcgggggtgctggagcgcgtgcagacacagctcttccggagcagccttcaccttctctctgggatcagtgtccggctggccgacgtggcatttgctgaccgaatgctcatagaggttgacccccacagggtcacgcaggactcggacactgccctggaaacatggatggacaagggcttttggccacaggtgtgggtgtcctgttggaggagggcttgtttggagaagggaggctggctgggggagaaacccggatcccgctgcatctccgcgcctgtgggtgcatgtcgcgtgctcatctgttgcacacagctcactcgtatgtcctgcactggtacatgcatctgtaatacagtttctacgtctatttaaggctaggagccgaatgtgccccattgtcagtgggtccacgtttctccccggctcctctgggctaaggcagtgtggcccgaagcttaaaaagttactcggtactgtttttaagaacacttttatagagttagtggaaggcaagttaagagccaatcactgatccccaagtgtttcttgagcatctggtctggggggaccactttgatcggacccacccttggaaagctcaggggtaggcccaggtgggatgctcaccctgtcactgagggttttggttggcatcgttgtttttgaatgtagcacaagcgatgagcaaactctataagagtgttttaaaaattaacttcccaggaagtgagttaaaaacaataaaagccctttcttgagttaaaaagaaaaaaaaaa

SEQ ID NO: 113396 - DNA, 5598 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000324774
  CDS Start-End: 830-2596
gagcctggggaggtcgagggtgcagcgagccgtgatcgtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 113397 - DNA, 5218 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000347034
  CDS Start-End: 579-2216
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 113398 - DNA, 5304 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000337174
  CDS Start-End: 579-2204
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 113399 - DNA, 2967 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000392473
  CDS Start-End: 830-2431
gagcctggggaggtcgagggtgcagcgagccgtgatcgtgctactgcactccagcctgggcaacacagagagaccctgtctcaaaacaaacaaacaaacaaacaaacaaacaaacaaaaaaaacaaagaaaaaaaaatgggagtgggccgggcgcggtgactcacacctgtaatcccagcactttcggaggccaaggcgggtggatcacgaggtcaggaattcaagattagcctggacaacatggtgaaaccccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacacta

SEQ ID NO: 113400 - DNA, 4453 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000392474
  CDS Start-End: 6-1676
gcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggtgccaag

SEQ ID NO: 113401 - DNA, 2051 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000402834
  CDS Start-End: 133-1899
cagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgtttt

SEQ ID NO: 113402 - DNA, 2116 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000404169
  CDS Start-End: 176-1942
gcgcgcccgccgcccgggcggaggagaggagcgcgcggccgcgcagagcaagctgagccgagccgagccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaa

SEQ ID NO: 113403 - DNA, 2587 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000446440
  CDS Start-End: 579-2051
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaagacctagaaaataagtccccttcctgcctgttgcaaagtaacgtaagagttccctcacccgagtggatgcagaccttcttgctgtcagccacccttccttcatacacatagccagcccaggtgaccagaacctcccaggacagatgaggctttgtgtccttatgagactgggagaacctgctgggcacccctgctgcaggtgctgtggtgggtggggaccccactgcccttcccactgagcacatcatggctacctgacttggtgggagctccaggcagtcacttctgtttcttaaacatagctttactgaggtacaattcacataccatgtaattcacccacgggaagtgtatgattcagtggtttctaatacagacttctgcagccattaccaccgtcaactttacgacattttcatcagcccaagaagacaccctacactccttagctgtccccatccaactcccccaccccagtaaccactcagaataggtatggatttgcctattctggacgtttcgtataaatggcgtcatacacta

SEQ ID NO: 113404 - DNA, 2006 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000412367
  CDS Start-End: 109-1734
ccgagctgggggcgcagagcgcgggaggcggcggcggcgcggagcccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaa

SEQ ID NO: 113405 - DNA, 3797 bp, Homo sapiens
  Payload ID: 2168
  Gene Symbol: CAMKK2
  Gene Name: calcium/calmodulin-dependent protein kinase kinase 2, beta
  ENST ID: ENST00000545538
  CDS Start-End: 68-1099
gccattaggatctcacactctgggggttttccctatcttccatcttaactgggaaacacgctgccaaatgcagccctcctgttggcaaacgcagccacgtggatgctgcctcctccctgctcatatctattctctctttttctcccccgccatccgtctcctgcctattccatgtggctgtgccaaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagctgcacccctgggtcacgaggcatggggcggagccgttgccgtcggaggatgagaactgcacgctggtcgaagtgactgaagaggaggtcgagaactcagtcaaacacattcccagcttggcaaccgtgatcctggtgaagaccatgatacgtaaacgctcctttgggaacccattcgagggcagccggcgggaggaacgctcactgtcagcgcctggaaacttgctcaccaaaaaaccaaccagggaatgtgagtccctgtctgagctcaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaa

SEQ ID NO: 113406 - DNA, 563 bp, Homo sapiens
  Payload ID: 2168
  Gene Symbol: CAMKK2
  Gene Name: calcium/calmodulin-dependent protein kinase kinase 2, beta
  ENST ID: ENST00000543477
  CDS Start-End: 189-563
aacgcacacttaaggctccagcaaagtaagtgccaaaaaggggagaatgggaagaatatgctgtatttcacaaaaagcatctaagtagccatctggaaaagccagaatgaacttcaatggtgcatccaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtcc

SEQ ID NO: 113407 - DNA, 543 bp, Homo sapiens
  Payload ID: 2168
  Gene Symbol: CAMKK2
  Gene Name: calcium/calmodulin-dependent protein kinase kinase 2, beta
  ENST ID: ENST00000544485
  CDS Start-End: 282-543
gagtcggtggtggcccaaagtccaggccgcatccaccgcccggcgcctagcgcaggggcagcagccgggtcgccacaggaggggccccgggtgttcttgccggcttgggggaactttcccagggtcagcccggaggcgccctgcagccccggcatttggctaaacaaagcaagcgctgccggcgcggcccgcccgagggcgccgcgggaagaacctgggcaggtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggt

SEQ ID NO: 113408 - DNA, 5175 bp, Homo sapiens
  Payload ID: 2168
  Gene Symbol: CAMKK2
  Gene Name: calcium/calmodulin-dependent protein kinase kinase 2, beta
  Uniprot ID: Q96RR4
  ENST ID: ENST00000538733
  CDS Start-End: 579-2075
cccatctctacgaaaaatacaaaaattagccaagtatggtggccggcgcctgtaatcccagctactcgggagactgaggcagagaactgcttgaacctgggaggcagaggttgcagtgatccgagatcgcgtcactgcactccagcgtgggcgacagagcgagactccgtttcagaaaagaaaaaaaaaaaaaaaaaaaagggagtcggggtggagctctcattggctcgttgcatgtgagtgtccctacggcctagaaatacaagagaagcacatcggaacgggctggaaatccacccagttaactagagggctttgaaccttttattaacttggaggttgactctcctgtcaactcgattcccttttggctgtttggcagggtcagtgagacatcccctgggtcgctcgaccccgtaggacggttcagggagccctccaggtcttcgtttctcctcttccccgcacagtgctgttatccagctgggggatccaacgcacacttaaggctccagcaaagtggctccgctgccggatgggagtgccccagtgtgctggatgaagctggcgcatgcaccatgtcatcatgtgtctctagccagcccagcagcaaccgggccgccccccaggatgagctggggggcaggggcagcagcagcagcgaaagccagaagccctgtgaggccctgcggggcctctcatccttgagcatccacctgggcatggagtccttcattgtggtcaccgagtgtgagccgggctgtgctgtggacctcggcttggcgcgggaccggcccctggaggccgatggccaagaggtcccccttgacacctccgggtcccaggcccggccccacctctccggtcgcaagctgtctctgcaagagcggtcccagggtgggctggcagccggtggcagcctggacatgaacggacgctgcatctgcccgtccctgccctactcacccgtcagctccccgcagtcctcgcctcggctgccccggcggccgacagtggagtctcaccacgtctccatcacgggtatgcaggactgtgtgcagctgaatcagtataccctgaaggatgaaattggaaagggctcctatggtgtcgtcaagttggcctacaatgaaaatgacaatacctactatgcaatgaaggtgctgtccaaaaagaagctgatccggcaggccggctttccacgtcgccctccaccccgaggcacccggccagctcctggaggctgcatccagcccaggggccccattgagcaggtgtaccaggaaattgccatcctcaagaagctggaccaccccaatgtggtgaagctggtggaggtcctggatgaccccaatgaggaccatctgtacatggtgttcgaactggtcaaccaagggcccgtgatggaagtgcccaccctcaaaccactctctgaagaccaggcccgtttctacttccaggatctgatcaaaggcatcgagtacttacactaccagaagatcatccaccgtgacatcaaaccttccaacctcctggtcggagaagatgggcacatcaagatcgctgactttggtgtgagcaatgaattcaagggcagtgacgcgctcctctccaacaccgtgggcacgcccgccttcatggcacccgagtcgctctctgagacccgcaagatcttctctgggaaggccttggatgtttgggccatgggtgtgacactatactgctttgtctttggccagtgcccattcatggacgagcggatcatgtgtttacacagtaagatcaagagtcaggccctggaatttccagaccagcccgacatagctgaggacttgaaggacctgatcacccgtatgctggacaagaaccccgagtcgaggatcgtggtgccggaaatcaagatcctggtgaagaccatgatacgtaaacgctcctttgggaacccattcgagggcagccggcgggaggaacgctcactgtcagcgcctggaaacttgctcacgaagcaaggcagcgaagacaacctccagggcaccgacccgccccccgtgggggaggaggaagtgctcttgtgagaggcagtccctgcgtggaaagttgctgggcccccgcccccggctcccccgcacgcatgcatccactgcggccggaggaggccatggagcccgagtagctgcctggatcgctcgacctcgcatgcgcgccgcgtcgcctctggggggctgctgcaccgcgtttccatagcagcatgtcctacggaaacccagcacgtgtgtagagcctcgatcgtcatctctggttatttgttttttcctttgttgttttaaaggggacaaaaaaaaaaaaaggacttgactccatgacgtcgaccgtggccgctggctggctggacaggcgggtgtgaggagttgcagacccaaacccacgtgcattttgggacaattgctttttaaaacgtttttatgccaaaaatccttcattgtgattttcagaaccacgtcagatataccaagtgactgtgtgtggggtttgacaactgtggaaaggcgagcagaaaactccggcggtctgaggccatggaggtggttgctgcatttgagagggagtagggggctagatgtggctcctagtgcaaaccggaaaccatggcaccttccagagccgtggtctcaaggagtcagagcagggctggccctcagtagctgcagggagctttgatgcaacttatttgtaagaaggatttttaaattttttatgggtagaattgtagtcaggaaaacagaaagggcttgaaatttaataagtgctgctggaaggggattttccaagcctggaagggtattcagcagctgtggtggggaaacatttctcctgaaagactgaacgtgtttcttcatgacagctgctcaaagcaggtttctgagatagctgaccgagctctggtaaatctctttgtcaaattacgaaaacttcagggtgaaatcctatgcttccatgtacattacatggcttaagattaaacaaaaacatttttcaagtctctaactagagtgaactctagagcacagtagttcagaaactatttagagcttccaggatatatttcacagcttcaggcatgtgatcagttagagccgatgaaacctatgcccgcctgtatatatattagcagcttagctagttcataacctgtatattctaaagactgctaaggttttgttttcattttaaatcctagctgattgttgtggtcaatgaaatacccagtttctggagggccaggtgggaaatgctttcactggaccaacacacaaatgatcatcctgaggatctgagcttccctagactccacacaataaccttggggcacccttttagagaagactgttgaaacccacagcactcgttggggtatgaggaaaccagggcttggcacaggaagttcccctttgtagctaaaagtccagaaagaaagggttcatctttttgacttccaactgatattgggaagtttggttgaggttcaagtgtgactccttccagagccacaggtaggggagtgtgaagttgagggggaggaaagctggaaggactctgccttgggagattcccagctctgctttccagcgcttggtggaatctgggctggggaaagacggcaccgggaaactctgcttccccattgtttccatctgatcagctgtggtgtgaggacttctcagacaaaggcaaggcctcgtgcccctgcccagcccattcatggagccctgggccttcttggcttccatagatcctaagctcttgactgtagtttagccagacttgttttgctatcttataagcagttcagaattagggaatgctggttttgaagagcaaaggacaggtagtctagagagggtcgtctggcctgcttgctgggtctttgtaacccagcacttcctcttgccctcctggctttatgtttatggggagaggactcaatagctccaccccttctggcaccagatggggcttggttagtttgcaataagcaccttgcagaggttaaagccagcgggtccctagtcttaggcccagcctgcttgtgtgggctctggcctggcctggtggctggcccagggggcagcagtgcttagagcttctgcagggcttctcttgtttacacagctgcatcagacaatgccatttctccccaccacggaaccttccatctaagatttcttccagggaatgccagcaatcaggcagcacccagctgtgggggcagtggggtgggggagacccacattgatgactttttttttttcttttaatgaagaaacaccaaagaaagctgtggaaaggacctgccccacatgaaaaggataagccaagatggctgtaaacacagagcatttgagctgccactcttggagcacattgatttttcaaaagccagctctgtcaggaaaggaggtgctgttatgagcagctcttccagtgggcaaagaggacgcccataatttcttccattgctagctcatctgtgggaccaatttggtgtaagcaacctgtggcctgcacttgtggcctcgaaggaagcacaaaccctccatccacttcccatttcctctgcccttttccacctcccccttccatcccaccagctgccagtggctcccagaaagccttattgagccccttgttgacacttggggctgcggaggcctctccctactggtctggcctttcctgagaggcaggtcttccgtcctcagagcctttctggaacaaggagaatgcctgtgcaggtggacacacaggcctggcctgtcgctctcacttgtcttccagcggggagcttcacgttgccgagtggaagaaccatgacctccacttgcttccaaggtgctagggaagtttcagggtacgctggttcccctctccagctggaggccgagtttctggggactgcagatttttctactctgtgatcgattcaatgcccgatgcttctgtttcattcccgaccctttctactatgcattttccttttatcaggtgtataaagttaaatactgtgtatttatcactaaaaagtacatgaacttaagagacaactaagcctttcgtgtttttccacaggtgtttaagcttctctgtacagttgaaataaacagacagcaaaatggt

SEQ ID NO: 113409 - DNA, 2494 bp, Homo sapiens
  Payload ID: 2169
  Gene Symbol: CASK
  Gene Name: calcium/calmodulin-dependent serine protein kinase (MAGUK family)
  ENST ID: ENST00000378154
  CDS Start-End: 476-2248
gccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggtaatgactctaacaaaccacccccatctgctctgagttcttaactaactgtctgctgatggctgtatgtttttgctttctgggaaattgtttctgcctgtgctgttagatcactgcacaccaattttacaacaaagataacggaacagagtaggtcccatccacctactcagccctgcttccatgtggatctcctcagcactttgaactttttgcaggctgaaatctgagcaaaatgtagagaagttacaaatgatgacataaggcttaataaggaaaaaa

SEQ ID NO: 113410 - DNA, 3848 bp, Homo sapiens
  Payload ID: 2169
  Gene Symbol: CASK
  Gene Name: calcium/calmodulin-dependent serine protein kinase (MAGUK family)
  Uniprot ID: O14936
  ENST ID: ENST00000378158
  CDS Start-End: 352-3081
cggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcgatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccagggg

SEQ ID NO: 113411 - DNA, 4411 bp, Homo sapiens
  Payload ID: 2169
  Gene Symbol: CASK
  Gene Name: calcium/calmodulin-dependent serine protein kinase (MAGUK family)
  Uniprot ID: O14936
  ENST ID: ENST00000378163
  CDS Start-End: 476-3256
gccgccgccacctccctccgcggcgatcctcgctccatggtcctgccgcggccccctctgtagcccgagctgctccgcgacgcgacggagccggcctcggacagagggagcggtcgcggcctcgcggcccgcgcgggctgacgagcggagagcgcgacgccgcgcggtccccgaggatccgcacgccgggcagcgcggcccgagcagcgcgagaagcagcgggcgggcgggcggcgccgggcccgggccgccctcgctcccgcgccccggccccgccgcccgcgccggggcggtcgcctgcagaggaaggcgccgcagtctctgggcctcgcggccccactcgagcgtcctcggcaccgagggctcgcgggtcctgaggggaggaggcgatcccggggctgggcactgagctcttgggcgcccccacccccgttttcgaagccctccacgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataact

SEQ ID NO: 113412 - DNA, 3123 bp, Homo sapiens
  Payload ID: 2169
  Gene Symbol: CASK
  Gene Name: calcium/calmodulin-dependent serine protein kinase (MAGUK family)
  Uniprot ID: O14936
  ENST ID: ENST00000378166
  CDS Start-End: 28-2793
cgctgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaataga

SEQ ID NO: 113413 - DNA, 2017 bp, Homo sapiens
  Payload ID: 2169
  Gene Symbol: CASK
  Gene Name: calcium/calmodulin-dependent serine protein kinase (MAGUK family)
  ENST ID: ENST00000378168
  CDS Start-End: 1-1146
gatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgagagagattccccttccacttccagacagtccccagctaatggtcatagcagcactaacaattctgtttcgatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataa

SEQ ID NO: 113414 - DNA, 2809 bp, Homo sapiens
  Payload ID: 2169
  Gene Symbol: CASK
  Gene Name: calcium/calmodulin-dependent serine protein kinase (MAGUK family)
  ENST ID: ENST00000378179
  CDS Start-End: 360-1916
gccagaaagcattctttcattttactctgtattcatgctattgaaagttgcttctgtcagaggaaacaaacactgtgattgaggaaatattgatgaattttaaatgacaaggaaattgccacattgacagaattttggtccatctatttaaagatgattttttgaaaagatatgcataagactcatattctgacaagtttcacagaacaattcagaggttattaccaagaggatcccactgaaatcatcagcctgcctttttaaaagaaaaatattgtttagtgaaataataaatatgaagctctgatttttagcaaagaattgtgagtgtttactggattttcttctttgctttttagctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgt

SEQ ID NO: 113415 - DNA, 2800 bp, Homo sapiens
  Payload ID: 2169
  Gene Symbol: CASK
  Gene Name: calcium/calmodulin-dependent serine protein kinase (MAGUK family)
  Uniprot ID: O14936
  ENST ID: ENST00000442742
  CDS Start-End: 20-2716
ccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggacttctagcagcagaaagagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtc

SEQ ID NO: 113416 - DNA, 8204 bp, Homo sapiens
  Payload ID: 2169
  Gene Symbol: CASK
  Gene Name: calcium/calmodulin-dependent serine protein kinase (MAGUK family)
  Uniprot ID: O14936
  ENST ID: ENST00000421587
  CDS Start-End: 25-2718
tgcggccgctatcccctccggaccatggccgacgacgacgtgctgttcgaggatgtgtacgagctgtgcgaggtgatcggaaagggtcccttcagtgttgtacgacgatgtatcaacagagaaactgggcaacaatttgctgtaaaaattgttgatgtagccaagttcacatcaagtccagggttaagtacagaagatctaaagcgggaagccagtatctgtcatatgctgaaacatccacacattgtagagttattggagacatatagctcagatggaatgctttacatggttttcgaatttatggatggagcagatctgtgttttgaaatcgtaaagcgagctgacgctggttttgtgtacagtgaagctgtagccagccattatatgagacagatactggaagctctacgctactgccatgataataacataattcacagggatgtgaagccccactgtgttctccttgcctcaaaagaaaactcggcacctgttaaacttggaggctttggggtagctattcaattaggggagtctggacttgtagctggaggacgtgttggaacacctcattttatggcaccagaagtggtcaaaagagagccttacggaaagcctgtagacgtctgggggtgcggtgtgatcctttttatcctgctcagtggttgtttgcctttttacggaaccaaggaaagattgtttgaaggcattattaaaggaaaatataagatgaatccaaggcagtggagccatatctctgaaagtgccaaagacctagtacgtcgcatgctgatgctggatccagctgaaaggatcactgtttatgaagcactgaatcacccatggcttaaggagcgggatcgttacgcctacaagattcatcttccagaaacagtagagcagctgaggaaattcaatgcaaggaggaaactaaagggtgcagtactagccgctgtgtcaagtcacaaattcaactcattctatggggatccccctgaagagttaccagatttctccgaagaccctacctcctcaggagcagtctcacaggtgctggacagcctggaagagattcatgcgcttacagactgcagtgaaaaggacctagattttctacacagtgttttccaggatcagcatcttcacacactactagatctgtatgacaaaattaacacaaagtcttcaccacaaatcaggaatcctccaagcgatgcagtacagagagccaaagaggtattggaagaaatttcatgttaccctgagaataacgacgcaaaggaactaaagcgtattttaacacaacctcatttcatggccttacttcagactcacgacgtagtggcacatgaagtttacagtgatgaagcattgagggtcacacctcctcccacctctccctatttaaacggcgattctccagaaagtgctaacggagacatggatatggagaatgtgaccagagttcggctggtacagtttcaaaagaacacagatgaaccaatgggaatcactttaaaaatgaatgaactaaatcattgtattgttgcaagaattatgcatgggggcatgattcacaggcaaggtacacttcatgttggtgatgaaattcgagaaatcaatggcatcagtgtggctaaccaaacagtggaacaactgcaaaaaatgcttagggaaatgcgggggagtattaccttcaagattgtgccaagttaccgcactcagtcttcgtcctgtgaggacttgccatcaactacccaaccaaaaggacgacagatctatgtaagagcacaatttgaatatgatccagccaaggatgacctcatcccctgtaaagaagctggcattcgattcagagttggtgacatcatccagattattagtaaggatgatcataattggtggcagggtaaactggaaaactccaaaaatggaactgcaggtctcattccttctcctgaacttcaggaatggcgagtagcttgcattgccatggagaagaccaaacaggagcagcaggccagctgtacttggtttggcaagaaaaagaagcagtacaaagataaatatttggcaaagcacaatgcagtgtttgatcaattagatcttgtcacatatgaagaagtagtaaaactgccagcattcaagaggaaaacactagtcttattaggcgcacatggtgttgggagaagacacataaaaaacactctcatcacaaagcacccagaccggtttgcgtaccctattccacatacaaccagacctccaaagaaagacgaagaaaatggaaagaattattactttgtatctcatgaccaaatgatgcaagacatctctaataacgagtacttggagtacggcagccacgaggatgcgatgtatgggacaaaactggagaccatccggaagatccacgagcaggggctgattgcaatactggacgtggagcctcaggcactgaaggtcctgagaactgcagagtttgctccttttgttgttttcattgctgcaccaactattactccaggtttaaatgaggatgaatctcttcagcgtctgcagaaggagtctgacatcttacagagaacatatgcacactacttcgatctcacaattatcaacaatgaaattgatgagacaatcagacatctggaggaagctgttgagctcgtgtgcacagccccacagtgggtccctgtctcctgggtctattaggcctctccccagatatctgagcataactgggagcacctcatttgtggaaaagcctctttgttatcggccttgtgtcagcaggtcatggtccctagagactacctagttgtagtgtgacctacatttataattattgtcatgtccgaatagataggaggagaaaaacaattacacactaatttaaagagacagtatcttttttaatcagttctcctaaactttaataaaatgtatctttaaatgtatgtattattcaatcctttggaatgttatatttttggaaatcatagctttttatttccaaggcccctaaaaactgcacaaaatagatgctgctttctataatctattttaataataataaacaatgattctgttaccttgactgggggtggaacactacattctttttagagtctgattttatggattggaatattgggatatctttctttcctttatttatttgaaataattagtgtagtgattacaaaacagtcataaatttttaaaggccttttttctctctttttttttttttagaatagtatttttttttaagtcctttatgtaacatccagataatgtgatactgtctctttgaagcaccctgtaaaccttttagagatttgaagttgggtcttgactcttaatgcatgtggacagtcgcgagcgtttatgctgtcggtgtgtctgtgttggacaaaacaatctgtaatctacagcaaagtacattctacattccgttcatggggcacacccaggggaataagaataaaatgctattatgactaagttgtaaacctatgcacatcccttgcattttgggcaactttataaaaaaaaagaaactgatttttattaataataatcatgtagtgaaatgtgtttgtaattttgtctcaatttaatttgttgtaaggtggggtggggggaattgctggtttcaccatttcagatctgtgttgtctaagagtattaacgttttaattaagcaaagaaatgatttttaatctgtatgtaattgttttaaagcacccattttaagagaaaatactgtgcaatgaagaaaccagtttaggcatttgctataaactgaaatattccaaaagaatcatctataacagccctgtaaattcctttaaaatgataactaacaggacagtttgaccaattttttttaaatatacttccttttatgtgttcaataattaaatgcctttgggtccttcatttcattatagatttgttcaggcttccaagctgataatctttacaattgtataatttgttagatgctcattgaacctttgaaggcccaggagtgagtatcagttggcagggtgacaaagtagcctgccagagcacagctggaccacgtctgactcgcacagagccatgcgcccaagggccacgggtgtactggaggccacctgtggtctctccttcctcttgctgtatcccttggcacaggggaatcatctgtccttgttgctttagagacattaaccatctcataactcttccatgaagtcacattcttccaatacaggagattcgggctggggttctcagactctttgccagaggtcagtagaatgtttttcattagcatgtgagggtgtgaagtgcttatattaacctgtgatccttgaaaacataccatcattttttgcttcttgtaggttagatggccttgtcactttgtgccttggcaggatgtgcagggtgtgttctgagctgaacagctcctcttaaaggaccaaacagagaaggcattagtatacttcttttacattgtcaacaccatacccgcctccgccccccaccgcctattattaaatggtggcgatttttttttttctgatgttgttctttgccagtgaccagatgagtctgcaacttactaacaaggtattgagtgaactacttctgtatgggccccacagtggggtgaccaagccaccaaaccagagataagctcaacagtggtctcacactagatagagagagaaaccttcaaagagttgggtagggctgtgttagaactgattcgaatctgatagatgccaaggccagacagtcgttcctggtatggtactgaccacaatttcgggctcttagtgtgaaggtgcgcactctacctcttttctggtgaagcacaaagacaactacaactaacacatgggaaacagaaacttccctccctctagtggaaacccccacgcccccacttgccctttgagcccacatctccagagatgctgatgatgcctgtcttaagccatctgccatatttataaaggtggattaagcagaggaggagaaaagcaatgccaacttaaatgtctgtggccccacaattcacaagcactgtagcactcatcctcagtggctttatacgtcctctgagaagcacacaggcaggcatcattcttgccatcattccgatggtgaaatccctgcatgcagaactcattgacttctcaaagatgttacctgttccattccactaatacatgtcttctctaaagcagtgtctttatgacctagctgcatatacttacatttctgaattcagagtaatttcagtacattgctgctgctgctgctgctgctgctgctgctgctgctgctgctgctgctgctactgctacattacaattgtccactaagcaatcagagaaaattgctaaaagcttctttactgcttccattccatcagcagaacctttttttttctttctttcttttaaagaccagaatgaatgtttagagtactaaatcttattagtggtcaattgaagtattggagagccacattttgaaggttctctcccccacccaactccattccccacagcaagaaagggagtgtttttatatgttgaattctttgttaaaaagatgaaatgtcctgattttccagtcacaagacagtaattactttgcacatacagcatatcccattttaatgctaaaaagggaaatgtcactcaatttaattcatctggaagtttcccagtgtcaagataacattgtagcctttttaaatgcaattaaatgtatctcttgtcaggtgagatgatttaaaatctttgctcagagaggaaaacaaatggttgacctacttcttgctatttgcattcagaaggcatcgtcccagcccatcctattggtggcagaatatctaaagatgtcgcaaagtcccccactgcagtagaaatgcaggaggtgttcctgttccccgtccaattccttcttaggctgctagagacagccagtgggccaagccttcccctgtgctccaggcaggcctgggctgcagctactgttacctttttacagcctttgatctgatcgctgcagagttcttttgtttttaaatcacttgtatttgtctcttcattaaggcttcaagtttatttcttgaaaaagtttagtcaattgaaccaccctccaggaagattcccagcgtggaaactgcccctgaaaaacaaggcagcccaaagccagctctcttttgtcccccactgatgtcatgtcctttttttttttcatttcaggccagtttcttaacttggggcaaagagaatgtgttgctaaagctaccaagaaaactgcttgattaacaaattcttaatagaaatgcctcccacactgtctctttgaaaagagaaggcaccttggaatcggcattccaaaaccaagctccttgtcatcctcatccctcctccttcttgcttcctattatcaaactcgtgtgtgtttcttgttttctcagaactgaacacagcctcctaattccatcctcttgactagggcttacaatactgagagcgattacaggctgtaataagttaaaggtccctgagcgtggctttcttgttctgcgcctctaattaattcttctattaaaagatgctttccttctcactgcagcttacagaaaggctacaagctttaatcacagatcatttcatttgccagagcctttccttttctaactcctttagaaataagatttccctctctgtttggaatctctggatacaggactctcctccaagctcatggcttgattggctttgcctgtgcacacacacatcagtttgccttaaacttggagctatggggagtcccagattttccagcttagtgggtgaagtttagctgtcacctacatccaggaagtgggggaaaagggaaaaaaagaggatattcaccaccatgttcccatccggtctttcccctgccttgctttgtgcagcaggtgggcagacagagcccacagaaacagaagtagaaagagggccgcaccatctctggggccagcactcctaagtcttagctctttgtgggaatagaaaatcctgagctcccaccacctctcgtctgaccctccatcaactccctcgaacctgtgcaaatggactgagcaaaagaaaatggaaagagatgtttgtcaccacacaggagacctcctttctggccccaagcacaactccatctctgcgtatgctcagaaactcagaatttagctgctacttatgtgttagctccattctctctggtgtgtgactgagagaacacgccagtgttcttactgacagaggcttaggggtgaccctctctggacccagaggaagtacaacctctgtagcgagaattgtccttgggaacagaaacaggcattcctccacagtgagtggctccccctattttttttttatttggaagagaccaagaattgggggaattgatttccagtcttagctgtttcccggaatgtcatctgtgcaggcaggtaggcggctgccgggtgcagcaggcagcgtgactgatgtgaaggccgcccaatcctcacgtgctaagacccgagtatcgtgtttaattgcagtgtaggcacgtcgccattcaaactcagttctggggtggttttgcataaagttttgccaacgtgttcttttttctgtatgtattattgcctttttataaaaggtgttgaagtattgtctcagtgataaaaagagagagatgttaatggttgttgtatatttcaccgtatccaattgtaagtatttgcagggtacagcagagccttagcttgcaagagcgtttgtgcaggaggtgtccctcaacacccaggagctgaagggattggaaaggtttggattctttgtaaatgtcctgcttttctttctctctgtgtgtatctatttacatgccttagcacacgccctcccatcctgatccctttgccctgtcgccggaacaaccagaatgctggtgcgctgccggcacagtacaagttgatgaaaccctaatcagttatcttgtgtgacaggggaagaagagaaactccatagtattccttgtagaatatacatacctgtaggatgctgtgtaatgggaaaccatagaattgggcttttgtcatttcaaagttggagaaatgtatgaataaaatgtataaaacatgaaaa

SEQ ID NO: 113417 - DNA, 1532 bp, Homo sapiens
  Payload ID: 2170
  Gene Symbol: CABS1
  Gene Name: calcium-binding protein, spermatid-specific 1
  Uniprot ID: Q96KC9
  ENST ID: ENST00000273936
  CDS Start-End: 75-1262
actgctctcctgcctagagataccactgagtccagaagcaagacctgtgagagtgcacagtgccacttcgccccatggctgaagatggtttgcccaaaatttattctcatcctccaacagaaagcagtaaaacaccaactgcagcaaccattttctttggggctgacaatgctattcccaaatcagaaacaactattacttcagaaggagaccacgtcacttcagtaaatgaatatatgctagaaagcgatttttcaacaactacagacaacaaactgacagctaaaaaggaaaaactcaaatcagaagatgatatggggaccgactttattaagtcaacaactcacctacagaaagaaattacctctctgactggcactacaaactccataacaagagactctattaccgaacatttcatgccagtgaaaattgggaatatttcatcaccagttactactgtttctttaatagatttttccactgacatagcaaaagaagatatcctcttagctaccattgacacaggagatgcagagatctcaataacctctgaagtctctggcacactaaaggacagcagtgctggtgttgctgacgctcctgcctttccacgtaaaaaggatgaagctgatatgagcaattataattcctccatcaaatccaatgtccctgctgatgaggctgtccaggtcactgattccactattcctgaggctgaaatccctcctgctcctgaagaaagcttcactactattccagacataactgcccttgaagaagagaaaataaccgaaattgacctaagtgttttagaagatgacaccagtgctgtggctacattaactgactctgatgagaagtttatcactgtgtttgaactcactacctctgctgaaaaagacaaagataaacgggaagatactctgctaactgatgaagaaactaccgagggagccagtatttggatggagagagatactgcaaatgaagcagagacccattctgttttgcttactgctgttgaatccagatatgacttcgttgtccctgcatcaatagctacaaacctagtggaagaatcatctacagaagaagatttgtctgaaactgataatacagagactgtacctaagatcactgagccattttctggaactacctctgtattagataccccagactataaggaagacacctccacaactgaaacggatatctttgaactactgaaagaagaacccgatgagttcatgatttaaaagcaacaaaagggataccatgtagaattgtgcaatagtctagccagctagccttaacatctaagaaatttttccaacaagcaaaaacctttagaaatgaaagaatgtgggcatttaaggtcttaaacactgaatatcacactcttcttatgactcttgttagcgattcaaggacataaatcttcattcttttctggcacagactacttaaatgggtctgttttcactttgctcatttttcttcaataaatctttttggcaagcaactga

SEQ ID NO: 113418 - DNA, 3783 bp, Homo sapiens
  Payload ID: 2171
  Gene Symbol: CASR
  Gene Name: calcium-sensing receptor
  Uniprot ID: P41180
  ENST ID: ENST00000490131
  CDS Start-End: 373-3609
caacaggcacctggctgcagccaggaaggaccgcacgccctttcgcgcaggagagtggaaggagggagctgtttgccagcaccgaggtcttgcggcacaggcaacgcttgacctgagtcttgcagaatgaaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccgtcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacacgagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggaagaggaatcgccccagactcctttcctctgaggaagaagggataatagacacatcaaatgccccgaatttagtcacaccatcttaaatgacagtgaattgacccatgttcccttt

SEQ ID NO: 113419 - DNA, 5017 bp, Homo sapiens
  Payload ID: 2171
  Gene Symbol: CASR
  Gene Name: calcium-sensing receptor
  ENST ID: ENST00000498619
  CDS Start-End: 439-3705
ggggctgctgtggccggacccgaaggcgggcgccgggagcgcagcgagccagacgcgcctctccaagaccgtgaccttggcatagggagcggggctgcgcgcagtcctgagatcagaccagagctcatcctcgtggagacccacggccgaggggccggagctgcctctgtgcgagggagccctggccgcggcgcagaaggcatcacaggaggcctctgcatgatgtggcttccaaagactcaaggaccacccacattacaagtctggattgaggaaggcagaaatggagattcaaacaccacgtcttctattattttattaatcaatctgtagacatgtgtccccactgcagggagtgaactgctccaagggagaaacttctgggagcctccaaactcctagctgtctcatcccttgccctggagagacggcagaaccatggcattttatagctgctgctgggtcctcttggcactcacctggcacacctctgcctacgggccagaccagcgagcccaaaagaagggggacattatccttggggggctctttcctattcattttggagtagcagctaaagatcaagatctcaaatcaaggccggagtctgtggaatgtatcaggtataatttccgtgggtttcgctggttacaggctatgatatttgccatagaggagataaacagcagcccagcccttcttcccaacttgacgctgggatacaggatatttgacacttgcaacaccgtttctaaggccttggaagccaccctgagttttgttgctcaaaacaaaattgattctttgaaccttgatgagttctgcaactgctcagagcacattccctctacgattgctgtggtgggagcaactggctcaggcgtctccacggcagtggcaaatctgctggggctcttctacattccccaggtcagttatgcctcctccagcagactcctcagcaacaagaatcaattcaagtctttcctccgaaccatccccaatgatgagcaccaggccactgccatggcagacatcatcgagtatttccgctggaactgggtgggcacaattgcagctgatgacgactatgggcggccggggattgagaaattccgagaggaagctgaggaaagggatatctgcatcgacttcagtgaactcatctcccagtactctgatgaggaagagatccagcatgtggtagaggtgattcaaaattccacggccaaagtcatcgtggttttctccagtggcccagatcttgagcccctcatcaaggagattgtccggcgcaatatcacgggcaagatctggctggccagcgaggcctgggccagctcctccctgatcgccatgcctcagtacttccacgtggttggcggcaccattggattcgctctgaaggctgggcagatcccaggcttccgggaattcctgaagaaggtccatcccaggaagtctgtccacaatggttttgccaaggagttttgggaagaaacatttaactgccacctccaagaaggtgcaaaaggacctttacctgtggacacctttctgagaggtcacgaagaaagtggcgacaggtttagcaacagctcgacagccttccgacccctctgtacaggggatgagaacatcagcagtgtcgagaccccttacatagattacacgcatttacggatatcctacaatgtgtacttagcagtctactccattgcccacgccttgcaagatatatatacctgcttacctgggagagggctcttcaccaatggctcctgtgcagacatcaagaaagttgaggcgtggcaggtcctgaagcacctacggcatctaaactttacaaacaatatgggggagcaggtgacctttgatgagtgtggtgacctggtggggaactattccatcatcaactggcacctctccccagaggatggctccatcgtgtttaaggaagtcgggtattacaacgtctatgccaagaagggagaaagactcttcatcaacgaggagaaaatcctgtggagtgggttctccagggagccactcacctttgtgctgtctgtcctccaggtgcccttctccaactgcagccgagactgcctggcagggaccaggaaagggatcattgagggggagcccacctgctgctttgagtgtgtggagtgtcctgatggggagtatagtgatgagacagatgccagtgcctgtaacaagtgcccagatgacttctggtccaatgagaaccacacctcctgcattgccaaggagatcgagtttctgtcgtggacggagccctttgggatcgcactcaccctctttgccgtgctgggcattttcctgacagcctttgtgctgggtgtgtttatcaagttccgcaacacacccattgtcaaggccaccaaccgagagctctcctacctcctcctcttctccctgctctgctgcttctccagctccctgttcttcatcggggagccccaggactggacgtgccgcctgcgccagccggcctttggcatcagcttcgtgctctgcatctcatgcatcctggtgaaaaccaaccgtgtcctcctggtgtttgaggccaagatccccaccagcttccaccgcaagtggtgggggctcaacctgcagttcctgctggttttcctctgcaccttcatgcagattgtcatctgtgtgatctggctctacaccgcgcccccgtcaagctaccgcaaccaggagctggaggatgagatcatcttcatcacgtgccacgagggctccctcatggccctgggcttcctgatcggctacacctgcctgctggctgccatctgcttcttctttgccttcaagtcccggaagctgccggagaacttcaatgaagccaagttcatcaccttcagcatgctcatcttcttcatcgtctggatctccttcattccagcctatgccagcacctatggcaagtttgtctctgccgtagaggtgattgccatcctggcagccagctttggcttgctggcgtgcatcttcttcaacaagatctacatcattctcttcaagccatcccgcaacaccatcgaggaggtgcgttgcagcaccgcagctcacgctttcaaggtggctgcccgggccacgctgcgccgcagcaacgtctcccgcaagcggtccagcagccttggaggctccacgggatccaccccctcctcctccatcagcagcaagagcaacagcgaagacccattcccacagcccgagaggcagaagcagcagcagccgctggccctaacccagcaagagcagcagcagcagcccctgaccctcccacagcagcaacgatctcagcagcagcccagatgcaagcagaaggtcatctttggcagcggcacggtcaccttctcactgagctttgatgagcctcagaagaacgccatggcccacaggaattctacgcaccagaactccctggaggcccagaaaagcagcgatacgctgacccgacacgagccattactcccgctgcagtgcggggaaacggacttagatctgaccgtccaggaaacaggtctgcaaggacctgtgggtggagaccagcggccagaggtggaggaccctgaagagttgtccccagcacttgtagtgtccagttcacagagctttgtcatcagtggtggaggcagcactgttacagaaaacgtagtgaattcataaaatggaaggagaagactgggctagggagaatgcagagaggtttcttggggtcccagggaagaggaatcgccccagactcctttcctctgaggaagaagggataatagacacatcaaatgccccgaatttagtcacaccatcttaaatgacagtgaattgacccatgttccctttaaaattaaaaaaaagaagagccttgtgtttctgtggttgcatttgtcaaagcattgagatctccacggtcagatttgctgttcacccacatctaatgtctcttcctctgttctatcccacccaacagctcagagatgaaactatggctttaaactaccctccagagtgtgcagactgatgggacatcaaatttgccaccactagagctgagagtctgaaagacagaatgtcaccagtcctgcccaatgccttgacaacagactgaattttaaatgttcacaacataaggagaatgtatctcctcctatttatgaaaaccatatgatattttgtctcctacctgctgctgctattatgtaacatccagaaggtttgcacccctcctataccatatgtctgcttctgtccaggacatgatactgatgccatgtttagattccaggatcacaagaatcacctcaaattgttaggaagggactgcataaaccaatgagctgtatctgtaattaatattcctatatgtagctttatccttaggaaaatgcttctgttgtaatagtccatggacaatataaactgaaaaatgtcagtctggtttatataaggcagtattattgagctctatttccccaccccactatcctcactcccataagctaagccttatgtgagccccttcagggactcaagggtccagaagtccctcccatctctaccccaaagaattcctgaagccagatccaccctatccctgtacagagtaagttctcaattattggcctgctaatagctgctagggtaggaaagcgtggttccaagaaagatccaccctcaaatgtcagagctatgttccctccagcagtggtattaatactgccggtcacccaggctctggagccagagagacagaccggggttcaagccatggcttcgtcatttgcaagctgagtgactgtaggcagggaaccttaacctctctaagccacagcttcttcatctttaaaataaggataataatcattctttcccctcagagctcttatgtggattaaacgagataatgtatataaagtactttagcctggtacctagcacacaataagcattcaataaatattagttaatattattactgata

SEQ ID NO: 113420 - DNA, 2766 bp, Homo sapiens
  Payload ID: 2172
  Gene Symbol: CACYBP
  Gene Name: calcyclin binding protein
  Uniprot ID: Q9HB71
  ENST ID: ENST00000367679
  CDS Start-End: 449-1135
gcgactgcgcagcgtggcccagcgcggtcaaattataatacataaaagttgtcagggcggagagcaagacattactcttctcggattgccggttcgctcgcgagacttgagcgttgctaggagattcggcaggcgggcggagccagactcggcggggcggggaggggtggggctaggctcggcgaggcgaggaagggtgggtggagccaggcttggcgggctgtgcgtgctcgcggtgggcggtggcggcggctgcctcgcgaaggttcgagatccgtcgcgtgcgggaggcgggccgcgatcttgcgcagggtcggtgtgggcgcaggctgcagcgccgcgactcgtgcgggtaggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttc

SEQ ID NO: 113421 - DNA, 243 bp, Homo sapiens
  Payload ID: 2172
  Gene Symbol: CACYBP
  Gene Name: calcyclin binding protein
  Uniprot ID: Q9HB71
  ENST ID: ENST00000406752
  CDS Start-End: 1-243
atggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggatgggatcagtcagataagtttgtga

SEQ ID NO: 113422 - DNA, 1059 bp, Homo sapiens
  Payload ID: 2172
  Gene Symbol: CACYBP
  Gene Name: calcyclin binding protein
  Uniprot ID: Q9HB71
  ENST ID: ENST00000405362
  CDS Start-End: 502-1059
atattccttatgccccccggctggagctgcagcgccagcctcccgccctaccgccgtttccgtgggctgagccgccctgcggccacccggtcccgcgccagtcagtgcgccgccttcccgggggacacctcactcgccccttgctgcgccgtcggctccccagcgcttccactcgacctcgcaccccactcgcctgctgggctcgagcgggggtgtgcggcgattatccgtgcaggcggtgcggggagtgggtctgggagagcggccctttgcgcgtgttcctcaggccctttctgccctggtttcccagccagtggacaggaagcttcattcaagcaaagctgggtgcaaacatgagtgtcgttcttggtagagggcggttggaagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttga

SEQ ID NO: 113423 - DNA, 499 bp, Homo sapiens
  Payload ID: 2172
  Gene Symbol: CACYBP
  Gene Name: calcyclin binding protein
  ENST ID: ENST00000426793
  CDS Start-End: 348-499
agaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcggcgtctgcgctcggtttgagggctcggcgcggggtttcctgttcctccttctgcgcggctgcagctcgggacttcggcctgacccagcccccatggcttcagaagagctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaa

SEQ ID NO: 113424 - DNA, 2835 bp, Homo sapiens
  Payload ID: 2172
  Gene Symbol: CACYBP
  Gene Name: calcyclin binding protein
  Uniprot ID: Q9HB71
  ENST ID: ENST00000613570
  CDS Start-End: 642-1199
cattttctttgatggtaaacaggctcacttataccgaatccaaacccaggcgagaactacggactcttgaaatggtcggtgaaaggggcgaaagcaccaggaaatcgtgcttcaacagtccatgactgaaaggagggcctgaaactgtggccataggcgggcccttttgttagggccttgacctgggcttccgctacagggcccggtcacgaggccaacgtagctccacctcctacggcggccagtgatgacgccaccacgtcggaactgttagaccgcggtgacgtctccaccgcgccaaactcactgaaaatcaaaccgctaccattaggagccctccacgcttaacatatccgttctttctcgtttgaaagtaaccaggctgctcctccccatttttcgccttcttctcgcggaggctgagagactaaccttacacaacatggcggcctggtgtgtctggtgtcctagagcggacgaaagcaggtgactctctagtcaacttccgacttggactccgaagatcgctacagaaagatctagaagaggtaaaggtgttgctggaaaaggctactaggaaaagagtacgtgatgcccttacagctgaaaaatccaagattgagacagaaatcaagaacaagatgcaacagaaatcacagaagaaagcagaacttcttgataatgaaaaaccagctgctgtggttgctcccattacaacgggctatacggtgaaaatcagtaattatggatgggatcagtcagataagtttgtgaaaatctacattaccttaactggagttcatcaagttcccactgagaatgtgcaggtgcatttcacagagaggtcatttgatcttttggtaaagaatctaaatgggaagagttactccatgattgtgaacaatctcttgaaacccatctctgtggaaggcagttcaaaaaaagtcaagactgatacagttcttatattgtgtagaaagaaagtggaaaacacaaggtgggattacctgacccaggttgaaaaggagtgcaaagaaaaagagaagccctcctatgacactgaaacagatcctagtgagggattgatgaatgttctaaagaaaatttatgaagatggagacgatgatatgaagcgaaccattaataaagcctgggtggaatcaagagagaagcaagccaaaggagacacggaattttgagactttaaagtcgttttgggaactgtgatgtgatgtggaaatactgatgtttccagtaagggaatattggtgagctgcatatataaatttgacagatagctatttacatagccttctaagtaaaggcaatgaattctccatttcctactggaggatttatttaaataaaatatgcttattaaacactcctgcaaagatggttttattagtaccctggtcattttgttcaaggaagggttatattgcattctcacgtgaaatataaaaagcaagtcttgcccaataaaaacgctacattgtgtgtattttttgttcagctaagaattggaaaagtatttgcttgccttttaagttactgacatcagcttccaccagtgtaaaaattgagtaaaacctgaagttttgcataaaatgcaaatcggtgcctgtgcttgaaggttgctgtagagcatctgaccccttattaccaccttaagcaatgtatatgccatgcattaccatgcactaattcaatcacaggtgtttctatctagatttaaatatatttgtcaatgaatgtggaatagaaaatctaaacatgacaataatagacatatctttgtatggtaccagttagttttgccgtggatcagatggtttataaaagtaataaccataaagcaaaaaataatttgaaagcccgtctattcctatgctcaataaagttaagtttttcttcattagaacagttttatgatttatttgtctaggagtatgtcagaaaaatcaggcttttagtaggaattactcctattccccctgaagtcaggaccagtgcctgtgatctccattactttattttcctggaggtattagccaacacagttagatcagagaaagcaattgaagccaggcatgaaggctggcgcccgtaatcccagctactaaggctggaggatcacttcagcccaggagtttaaggctgcagtgagctatgatgatgccactgtactgcagcttgggtaacagattgagaacctgtctcattaaaaaaaaaaaaaaaaaaaaagccgttagacacacaggaaaaatccagaagggtaaactaaactaaagctacaattaatatgggaatttggaagaagtggtaggatttaaaatacagaaacagtttatgtataggatagctataagtaaatactgaaacacattatgcctctgtaattggggttgacacatgaacagaatagcagacacaatgcatatgaaagttacagaatatggtaaaagtggggtaaagatgggtttttaatgatactaagataactgaaaataggcatatagatatattccaagccgcctgacgatctaattgtaaaaagtaaagcatacaaatactagaagaaaatggaggaaaacgacattatatgtgacttaaaacctagaagaaataaataaaactattgatcaattttaactacataaaaatgtttataggacaagaaaaaccccaccataacccaaggcaaacaatgtattgacaggattccaataattaagaatacttcatacaaaaagaaatgtaaatgacctttaacatgtaaagatgctcaccttgttcagaagagaataaaccagtgtttttacctttcacttg

SEQ ID NO: 113425 - DNA, 2271 bp, Homo sapiens
  Payload ID: 2173
  Gene Symbol: CALY
  Gene Name: calcyon neuron-specific vesicular protein
  Uniprot ID: Q9NYX4
  ENST ID: ENST00000252939
  CDS Start-End: 95-748
gcatcctccgcatccacatccgcatcgtcgtcctccccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggggcggcggcggcggccaccgaaccccccgggaagccgtcggccaaggcggagaaggaggcggcgcggaaggcggccgggagcgcggcgcccccgcccgcgcagtgacgtctccagccccgcagcccggcccgggcgtcctccgccagctcctgtgaccagcgcgtctcccgatgctctccgccgtgttcgtgtccccaggcgccctcgctgcagccccgcccccgtgggtctctgactctgtcgcttttctctaagtaaagatttcacgtccaccggaggcttccatctctcctgcgcgtcctctgccgggctggcctttctcccgccccccaccccgccagttgtgagtgaggccggcattgtgctccccccagggacccccgaaggacccaggagagaccccgtggggggcagctcccaggaagccgtggtgcgcccaggcggagcacgcgcatcctcgcgctgcgtggtccgggccttgtccaagccccaccgggatgtgccttaatggcggggctccggcccacccaggggagcctcgggtccatccctatccgctgcccagccccttgtcctgctggttccccgaccccccgcccccatctacctggtgctgggcctgggccccgggcgttccccctctgacaggagtgtctgcctcccgggggacccctggttctgggcggcacccatgagcagctcctgcctcctagatgtgtggcccacaggcataaatgaccaagtgaagaaaggagtgaatgggggcgtctgagtggggagtggggcctgatgaggggtgagctctggttcctgggggctggggtctcccgtgtccctggagccagatgaaagatggtgaggctgaaacgccaggggagcctggagctgccatgagtctcccccagcatccccaccccagccccagcatccccaccccagccccagcatccccaccccagccccagccaactcccggcactgaacactacagggaatggacttccggcagatctcacccaccacctgcaccaccccagccagcagcagctctgcagccccgcccaccccagccagcagcagctctgcagccccgcccaccccagccagcagcagctctgcagccccgcccaccccagccaattgcagcactgcagccccgcccaccccagccaattgcagcactgcagccccgcccaccccagccagcagcggctctgcagccccgcccaccccagcccccgaccattggtggatggaagccccccaccattggctcccaggcttgctggctaggtgcgggtctaggcagcttcccagctcagtgggactggcctgctttggaacagcggcagtgcccaggaagcctgtgaactgggcctgccagggaagccatggtgagctggaagccagccaggtggggtcagggaaggcagggccatgcacaccacacccttcactgctgggcttctaagggcattggccagatgaacaagcacacgcagaactgaattggccctgatggcctgcaagggaggggggcccggggcctggggcgtcagctgggatatatgggggcagggagtctctgcatggccgatgtttgaattaaaatacagctttcccctgta

SEQ ID NO: 113426 - DNA, 783 bp, Homo sapiens
  Payload ID: 2173
  Gene Symbol: CALY
  Gene Name: calcyon neuron-specific vesicular protein
  Uniprot ID: Q9NYX4
  ENST ID: ENST00000368555
  CDS Start-End: 60-536
cccgaccgcgtcctgcagcagctgccagtggagccgcctgacaaggactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcagggtaaccacacccaccccacccactgtggggactcaggacaggaggagaaggtggaaggcagctgggggtgcctgggttccgtccaggccagtctggggtccccttgctctcagggaggagagggtggcagtgagtcatcccgcccagagctggccccaccggctgccctgcacccaccaggccccctcccgaggctgcaggtgcagactgaccaaacagtggcgctcctgagatgtttttctttctgggaagtgcccgcgagtgctgcttgcttgtttgcccagtgggtcattgtctcatcttcagtgacttacgggctttctatgtaatacttcctttctgcagtatatctggcaaatatcttctctcatcctcttgtttaaatctgtcaatgttactaatgatagctttagtcatttttagtggactgtttccaaagccttccattctccagtagacagatctgctagggctcccc

SEQ ID NO: 113427 - DNA, 825 bp, Homo sapiens
  Payload ID: 2173
  Gene Symbol: CALY
  Gene Name: calcyon neuron-specific vesicular protein
  Uniprot ID: Q9NYX4
  ENST ID: ENST00000368558
  CDS Start-End: 117-491
cccgcccggccgcgaagcgtctggaaccgcatcctccgcatccacatccgcatcgtcgtcctccccgaccgcgtcctgcagcagctgccagtggagccgcctgactgccatccaccatggtgaagctgggctgcagcttctctgggaagccaggtaaagaccctggggaccaggatggggctgccatggacagtgtgcctctgatcagccccttggacatcagccagctccagccgccactccctgaccaggtggtcatcaagacacagacagaataccagctgtcctccccagaccagcagaatttccctgacctggagggccagaggctgaactgcagccacccagaggaagggcgcaggctgcccaccgcacggatgatcgccttcgccatggcgctactgggctgcgtgctgatcatgtacaaggccatctggtacgaccagttcacctgccccgacggcttcctgctgcggggccctgagttctgaactggaggctgatcttcggtgtcctgaagccatggctccattacaaactgtccgcagtgtccccaaccgcagaagcgggagggcctgggcccggggcgcacaggagggctcagccccaccgaccctgacccggcccctcccgcagcacaagatctgcacgccgctgaccctggagatgtactacacggagatggaccccgagcgccaccgcagcatcctggcggccatcggggcctacccgctgagccgcaagcacggcacggagacgccggcggcctggggggacggctaccgcgcagccaaggaggagcgcaaggggcccacccaggctggg

SEQ ID NO: 113428 - DNA, 489 bp, Homo sapiens
  Payload ID: 2174
  Gene Symbol: CAPS
  Gene Name: calcyphosine
  Uniprot ID: Q13938
  ENST ID: ENST00000222125
  CDS Start-End: 1-489
atggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtcacactggcggaattccaggactactacagcggcgtgagtgcctccatgaacacggatgaggagttcgtggccatgatgaccagtgcctggcagctgtga

SEQ ID NO: 113429 - DNA, 1789 bp, Homo sapiens
  Payload ID: 2174
  Gene Symbol: CAPS
  Gene Name: calcyphosine
  Uniprot ID: Q13938
  ENST ID: ENST00000452990
  CDS Start-End: 488-1234
ttttaagtagagacagggtttcaccatgttggccaggctggtctcaaactcctgacctcaggtgatctgtctgcctcggcctcccaaagtgctgtgattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcacccatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagagatcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacatgtcca

SEQ ID NO: 113430 - DNA, 3750 bp, Homo sapiens
  Payload ID: 2174
  Gene Symbol: CAPS
  Gene Name: calcyphosine
  ENST ID: ENST00000588776
  CDS Start-End: 2368-3195
ctgccaccctgccacccaggctgaagtacagtggtgtgatctaggctcactgcaacctctgcctccagggttcaagtgattctcctgccttggcctcctgagtagctgggattacaggcatgcaccaccatgcccagctatttattttttttagtagagatggggtttcaaaatgttggccaggctggtcttgaactcctgacctcaagtgatccgcccacctcagcctcccaaagtgctgggattacagctgtgagccaccgcgcccagccctggcctctttttttaagttatttatttatttttgagacagagtctcactctgtcgcccaggctgtggtgcagtggcatggtcttggttcactgcaacctctgcctcctgggttcaagtgattctcctgcctcagcctctggagtaggtgggattacaggcacccgccaccatacctggctaattttctttttttttttttgagacaaagtcttgctcttgtcccccagtctggagtgcaatggcacgatctcggctcactgcaacctccgcttcccaggttcatgcaattctcctgcctcagcctcccgagtagctgggattacaggcacataccaccacgcccagctagtttttcgtattttaagtagagacagggtttcaccatgttggccaggctggtctcaaactcctgacctcaggtgatctgtctgcctcggcctcccaaagtgctgtgattacaggcatgagccaccgcacccggctgactaatttttgtatttatagtagagacagggtttcaccatgttggccaggctggtctcgaactgctgacctcatgatctgcccgcctcggcctcccaaagtgctgggattacaggcgtgagccaccgtgcccggccagtttatttacttatttttaagaggcgggcgtcttgctctgtaacccaggctggagtgcagtggtgcgatcatagctcactgcagcctccaactcccgggctcaagtgatcctcctgcctcagccttccaagtaggtgggattacaggaacacaccaccatgcctggctaattttttgtagtttttgtagagatgggggggtctcactatgttgcacaggcgggtctcaaactcctgggctcaagtgatcttcctgccctggcttcccaaagtgttgggattacaggcatgagccaccgcgctcaggcaaggcaacttctgacaatataattgtgctgtgagcgaggtaaagccaggcttggagaaggctccgattgatgatccttgggtcggggcgaacagtgggtcctcaaacagggcccacgtttcaagtcctggaaaacccacctatcttagcgggcaggtatatccgatgtctccgttgaaggccttcagtgaggtggcttcgtctcttgaggtttatgtccaggatcagggctgctcttccactcggggtcacaacctctggctcaccaccttgtcaggagccagcccactaagtcacgtttcaggcctgaaaaccaacaacaaaagatccgtaaagacagaaatcctgggactggctcctaacaacggccagtgacaagctttgtggcagtgagcagaggtgtccctcaggctcagctcagtctctgtgggttgcaggacctgcccttggaggtgggcctgggtgggaggtcttagggccccaggacctgggccacctggggctttttttttttttttctttttgagatggagtcttgctctgtcgcccagactggagtgcagtggtgcaatcttggctcactgcaagctccacctcctgggttcaagcgattctcctgcctcagcttcctaagtagctcggattacaggcgcccaccatcatgcacggctaatttttgtatttttagtagaggcggggtttcaccatgttggtcaggctggtctcaaactcctcaccttgtgatctgcccacctcggcctcccaaagtgctgggattacaggcatgagccaccgcgcccagcccacctggggcatttttgttgctgtacaatagaaacaagttctctatatgttccccaggctggtccaaactcctgggctcaagtgatcctcccacctagacctcccaaagtgctgggatttcaggcatgagccgcagtggccggtcagaacctggggcccttttgaactttgattcctcagcaattttgtcagccctggctcgggctgagaagcccctgtgaagccagagagggaaagggacctgtccagggtcacacaggaatcatgcgtcaagcctccccagccacggacttgtctccatccagggcatttcagcccctgcagggcagtggcctgcccctcctccttggagccaggaagggatgcagtgccacagggatctggctctgtcccaggccctgtggggctggcagttgagtaagcagtcaggctgggcgcacccatccctcccccactccccactgcccagcacagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagagatcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacatgtcca

SEQ ID NO: 113431 - DNA, 537 bp, Homo sapiens
  Payload ID: 2174
  Gene Symbol: CAPS
  Gene Name: calcyphosine
  ENST ID: ENST00000588865
  CDS Start-End: 135-537
gccccgcaggcaggactctgggacagacgcaggccaggtgagcatctgaacaaggggcagtcggccagggtgggcttgcgggagtccccaccttgacctctctcccttccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagt

SEQ ID NO: 113432 - DNA, 1606 bp, Homo sapiens
  Payload ID: 2174
  Gene Symbol: CAPS
  Gene Name: calcyphosine
  Uniprot ID: Q13938
  ENST ID: ENST00000618299
  CDS Start-End: 151-720
acagtgcattcatgcagctgggccccaccccatctccagaggcaccttccactagcaacagtctccccaggcacaacacagctaacacaaggccccgcaggcaggactctgggacagacgcaggccagctgcccagagcccagaccaagcatggacgccgtggatgccaccatggagaaactccgggcacagtgcctgtcccgcggggcctcgggcatccagggcctggccaggtttttccgccaactagaccgggacgggagcagatccctggacgctgatgagttccggcagggtctggccaaactcgggctggtgctggaccaggcggaggcagagggtgtgtgcaggaagtgggaccgcaatggcagcgggacgctggatctggaggagttccttcgggcgctgcggccccccatgtcccaggcccgggaggctgtcatcgcagctgcatttgccaagctggaccgcagtggggacggcgtcgtgacggtggacgacctccgcggggtgtacagtggccgtgcccaccccaaggtgcgcagtggggagtggaccgaggacgaggtgctgcgccgcttcctggacaacttcgactcctctgagaaggacgggcaggtcacactggcggaattccaggactactacagcggcgtgagtgcctccatgaacacggatgaggagttcgtggccatgatgaccagtgcctggcagctgtgagcagctccggctcagccctgctgccctggcctgtcactccccacccctgccggagacctcccttccctgggccccttctctcctgggcagccacaccacagagcggggaggggcaggtgggggaatggaggctgcaggactggctagaccaggtccctgccggtccaccaggcggaggtgggacaaaggtcctaacaggagtcactggctcaggaccccagggagaaacgctctccccacccacgccatgctgaccagagatcttgcagcccctgtggatgcccccgccgaggtcccccgatccccgcacccggactgctgctccctgcccctcccttgcgggtcccccaggaagccaggtgaccccaggtgggaggctgtgtgtggaggccatcctggaaggaagtttagacctgcccaggtgtggagcgaggggcacaggggcatcctaacctcagaaactgaaataaagcctttgaaaaaaaaatctgtaaaacatcaacccccaatcagaagatggcaaatggggaataaaaatagcaggtaacatgtccagcgggcccagtatctacattctggtgagcggcccgaggctgggagctctgggcgggggcagaccggcggggccttgcagcaggggtgggggtaaagtgcgggtggtggtggagagaacagggctgtggctggaccccagcactggtgacacgctgggtgggagcatgaggccccaggctgctggaggtcctcgcccggggaggtggaggccgttcctggtcaggggcttcctgaggcccctggggcatgcagaggccagggttttagttaaaagtttaatgtagttcccaaatacatttcatatgacaatcttacataaatgttccaaaac

SEQ ID NO: 113433 - DNA, 3831 bp, Homo sapiens
  Payload ID: 2175
  Gene Symbol: CAPS2
  Gene Name: calcyphosine 2
  ENST ID: ENST00000328705
  CDS Start-End: 53-178
gggggagaggaggggaaagctagacctgcagagtgaagaaagctggtaatagatgtctgacaaactaaagaaagacttgtgttaccacaattcagacagcccggaatatcaagattcatctttttcactaattgtggcattcacagatgcaaagtattgttcctgggtgtgtctgtgagagtattgccaaaggagagcagtgaactgggaaaagcagacccacctcaatgtgggtgggcaacatccaatcggctgccagctagaataaaccaggcaggagaagatggaagagccgacttgctgaatcttccagccttcatctttctcgtgtgctggatgcttcctgccctcaaacatcagactccaggttcttcgtcttttggactctcggatttacatcagtggtttaccaggtgctctcaggccttcagccacacactgaaggctgaattgtcggcttcccgacttttgagattttgaaacttggactgagctactgctggcttccttgcttctcaacttacagatgggacttcacctatagatcatcaaaggtggacttctgagtcatggacaaaccagaattcttgcccaccagtggtcccacgacttgatttgggaagccttgttgactctgatgatgaggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagtaagttgtcagcatttttacttatttggaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggccattcaacagaggaagaaatcaaatcatcctttctagaaacattaaaagttgcctgcagcaagtctgatgaagtgtcatatggtgaatttgaagattactatgaaggtttaagtataggaatagtagatgatgaagactttgttaacatcttacgtactccatgggggatttagtctttaataatacatatgtcatcaacactaagcattttattggagagatgatatcaatgtaaaggatgatcaaacactggaatatattttcctaggacttcctttattctggtttcttgtttgtttgttttgttttgttttgttttctcaaaaatgttgaatttggaaagagaactatccagaaagatagatgtaggggtgtgttagtgtttgtgcatgtgtatgcctgttcacatgtccttacatttgtaaagatatctttttggtttattacttatcttgcgtatattttagaggtcattttttattaacttcagtaggaaagttacatctgcatcaaacaatatggcaacatctatttattaaccaagtttcctgtcctttcacattgttttttgctacctcttcctcagaatatatttgccaccatggtcaatttgataaattagaattgggcccaaagccagtgagataattcaatgtgtttttaacacatgaaaatattaaaggatatgcaagagaaatttttcaagcagtgtgattatagatgttttctgtatatagaatatttcaaatgatggaggtttaccccatgatgctcatttaaatactgacttgtcttttaaatctgtcttctaaattatgtactgttgttggttaaatagagcacaatgtagttattctaatgcccagttgtatttgttcttttattctgctttttaactgtaatcctttttaccagcatacgattgttattgagcaatatgaaagggaaatgttctttattaaaatcaatacattatcttattaaacaaagatcctaaaagtatattgttgcatatatgaatccaaggaatagttcagtaattattgcctaaaatgtgaaagcatattttgtatcctaaaatgaatgtatgatattctaaacatctgttttagtataacaaacaattgaaacatttccttctaaatatatgttatttaatagttacatgtattataatcattctttctaaattctttgctagtcatttcttcctgggaatacagagaaaagagacaactttatgagttgttttcaacttcataattttaaattttctatgttaatataacataaattagaaaaaataagtgattcaaaatgaaaatatttactttgtagaatatgactttagacatatcactgtatccatctatacttggcagcaacatgagaagtgtgatacatgtgaacccaacaaattcaaagttgcacttttcaagatgtgagaaggtactaaaacttaatactaaaacatgagagggaaaatatgtgtaaacctctagtgctattttcactggctaaattctttatttcttgatttttttaaaaattaggttattaaaattaaaacaatatgctagaagacattttggcagaaataagtctataacactatttttgtcacatatctttttcttggaaaaatttatccaactatagacatcttaaaccctacaaattgttcttgttaaaaatgactaatactgggggtgctcaatatgcatatagtgtttttcattgataatttttatttagttcttaagaaacctgttcttaatgttggcatgtcacatttttctgttactataatcagaaaatgtatagtctgttatac

SEQ ID NO: 113434 - DNA, 2569 bp, Homo sapiens
  Payload ID: 2175
  Gene Symbol: CAPS2
  Gene Name: calcyphosine 2
  ENST ID: ENST00000336815
  CDS Start-End: 52-480
ggggagaggaggggaaagctagacctgcagagtgaagaaagctggtaatagatgtctgacaaactaaagaaagacttgtgttacgatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagtaagttgtcagcatttttacttatttggaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaaggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggccattcaacagaggaagaaatcaaatcatcctttctagaaacattaaaagttgcctgcagcaagtctgatgaagtgtcatatggtgaatttgaagattactatgaaggtttaagtataggaatagtagatgatgaagactttgttaacatcttacgtactccatgggggatttagtctttaataatacatatgtcatcaacactaagcattttattggagagatgatatcaatgtaaaggatgatcaaacactggaatatattttcctaggacttcctttattctggtttcttgtttgtttgttttgttttgttttgttttctcaaaaatgttgaatttggaaagagaactatccagaaagatagatgtaggggtgtgttagtgtttgtgcatgtgtatgcctgttcacatgtccttacatttgtaaagatatctttttggtttattacttatcttgcgtatattttagaggtcattttttattaacttcagtaggaaagttacatctgcatcaaacaatatggcaacatctatttattaaccaagtttcctgtcctttcacattgttttttgctacctcttcctcagaatatatttgccaccatggtcaatttgataaattagaattgggcccaaagccagtgagataattcaatgtgtttttaacacatgaaaatattaaaggatatgcaagagaaatttttcaagcagtgtgattatagatgttttctgtatatagaatatttcaaatgatggaggtttaccccatgatgctcatttaaatactgacttgtcttttaaatctgtcttctaaattatgtactgttgttggttaaatagagcacaatgtagttattctaatgcccagttgtatttgttcttttattctgctttttaactgtaatcctttttaccagcatacgattgttattgagcaatatgaaagggaaatgttctttattaaaatcaatacattatcttattaaacaaagatcctaaaagtatattgttgcatatatgaatccaaggaatagttcagtaattattgcctaaaatgtgaaagcatattttgtatcctaaaatgaatgtatgatattctaaacatctgttttagtataacaaacaattgaaacatttccttctaaatatatgttatttaatagttacatgtattataatcattctttctaaattctttgctagtcatttcttcctgggaatacagagaaaagagacaactttatgagttgttttcaacttcataattttaaattttctatgttaatataacataaattagaaaaaataagtgattcaaaatgaaaatatttactttgtagaatatgactttagacatatcactgtatccatctatacttggcagcaacatgagaagtgtg

SEQ ID NO: 113435 - DNA, 3430 bp, Homo sapiens
  Payload ID: 2175
  Gene Symbol: CAPS2
  Gene Name: calcyphosine 2
  Uniprot ID: Q9BXY5
  ENST ID: ENST00000393284
  CDS Start-End: 603-1751
ggagccaaattcagccattctttggaagaaagaagcctctacaacaaaggtggacttctgagtcatggacaaaccagaattcttgcccaccagtggtcccacgacttgatttgggaagccttgttgactctgatgatgaggacaatttttcatatattccacttagtacagcaaacctgccaaattcatcttctactcttggctgggtcacaccatgtcaaactccatatactcagtatcatctaaataaattggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggccattcaacagaggaagaaatcaaatcatcctttctagaaacattaaaagttgcctgcagcaagtctgatgaagtgtcatatggtgaatttgaagattactatgaaggtttaagtataggaatagtagatgatgaagactttgttaacatcttacgtactccatgggggatttagtctttaataatacatatgtcatcaacactaagcattttattggagagatgatatcaatgtaaaggatgatcaaacactggaatatattttcctaggacttcctttattctggtttcttgtttgtttgttttgttttgttttgttttctcaaaaatgttgaatttggaaagagaactatccagaaagatagatgtaggggtgtgttagtgtttgtgcatgtgtatgcctgttcacatgtccttacatttgtaaagatatctttttggtttattacttatcttgcgtatattttagaggtcattttttattaacttcagtaggaaagttacatctgcatcaaacaatatggcaacatctatttattaaccaagtttcctgtcctttcacattgttttttgctacctcttcctcagaatatatttgccaccatggtcaatttgataaattagaattgggcccaaagccagtgagataattcaatgtgtttttaacacatgaaaatattaaaggatatgcaagagaaatttttcaagcagtgtgattatagatgttttctgtatatagaatatttcaaatgatggaggtttaccccatgatgctcatttaaatactgacttgtcttttaaatctgtcttctaaattatgtactgttgttggttaaatagagcacaatgtagttattctaatgcccagttgtatttgttcttttattctgctttttaactgtaatcctttttaccagcatacgattgttattgagcaatatgaaagggaaatgttctttattaaaatcaatacattatcttattaaacaaagatcctaaaagtatattgttgcatatatgaatccaaggaatagttcagtaattattgcctaaaatgtgaaagcatattttgtatcctaaaatgaatgtatgatattctaaacatctgttttagtataacaaacaattgaaacatttccttctaaatatatgttatttaatagttacatgtattataatcattctttctaaattctttgctagtcatttcttcctgggaatacagagaaaagagacaactttatgagttgttttcaacttcataattttaaattttctatgttaatataacataaattagaaaaaataagtgattcaaaatgaaaatatttactttgtagaatatgactttagacatatcactgtatccatctatacttggcagcaacatgagaagtgtgatacatgtgaacccaacaaattcaaagttgcacttttcaagatgtgagaaggtactaaaacttaatactaaaacatgagagggaaaatatgtgtaaacctctagtgctattttcactggctaaattctttatttcttgatttttttaaaaattaggttattaaaattaaaacaatatgctagaagacattttggcagaaataagtctataacactatttttgtcacatatctttttcttggaaaaatttatccaactatagacatcttaaaccctacaaattgttcttgttaaaaatgactaatactgggggtgctcaatatgcatatagtgtttttcattgataatttttatttagttcttaagaaacctgttcttaatgttggcatgtcacatttttctgttactataatcagaaaatgtatagtctgttatactgtaaaaaaaaaaaaaaa

SEQ ID NO: 113436 - DNA, 2135 bp, Homo sapiens
  Payload ID: 2175
  Gene Symbol: CAPS2
  Gene Name: calcyphosine 2
  Uniprot ID: Q9BXY5
  ENST ID: ENST00000409445
  CDS Start-End: 198-1871
agacgcgggcctggactgtctagactgtcctgtctaaagctttctgaatgcggtttttggaggaatcgcgctagtttataccttttccaactcttctaactctggacctcttcttaccgagcttgttaggtgaaatcaggctgactgtctcttgtgcccctcgcctgtcctgtccaggaatcccagttaggtaggggatggggaattccttctgctacactgcagtatactgcatgataaacacaggaactcaaatggatttagaggttaaaggagttgctgccacttctaggagccaaattcagccattctttggaagaaagaagcctctacaacaaaggtggacttctgagtcatggacaaaccagaattcttgcccaccagtggtcccacgacttgatttgggaagccttgttgactctgatgatgaggacaatttttcatatattccacttagtacagcaaacctgccaaattcatcttctactcttggctgggtcacaccatgtcaaactccatatactcagtatcatctaaataaattggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgtaatggacgtgatgcttgcagagagctcattgggttctttttcactcatgaccaatcccttacaatttatgaatatcgacaatttgggaaaaatagaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggttgaccagcaaggacaaacatgaaaatgcttaaaaaaaagaaagcgcttaaaacaaagaaatagaaggtaatgggcatatataaaataagccaagcaagagaagagcaaagacaatctgcagggtggacatggatgtattcgtttctgatcatgagaagaggctcttgtcatacatatcgttccatttttattttaaagttctataaacttctgaggtaaactgatttcttggatgtacttaataaagaataaatgtttcatattgga

SEQ ID NO: 113437 - DNA, 1859 bp, Homo sapiens
  Payload ID: 2175
  Gene Symbol: CAPS2
  Gene Name: calcyphosine 2
  ENST ID: ENST00000409799
  CDS Start-End: 168-1595
gtctaaagctttctgaatgcggtttttggaggaatcgcgctagtttataccttttccaactcttctaactctggacctcttcttaccgagcttgttaggtgaaatcaggctgactgtctcttgtgcccctcgcctgtcctgtccaggaatcccagttagtatactgcatgataaacacaggaactcaaatggatttagaggttaaaggagttgctgccacttctaggagccaaattcagccattctttggaagaaagaagcctctacaacaaaggtggacttctgagtcatggacaaaccagaattcttgcccaccagtggtcccacgacttgatttgggaagccttgttgactctgatgatgaggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctcataaattacagtttgatggtaggatcgtatcacgaacaaatgtgcttccttttattcaaaaaagcatttatagtcatcagtgtggacgaagaaaaggaaaacaataccgacttggtgatttttatgttggtgcaaccttgacatttttgagttctgatcatctcagccttccagaaagcatcaaagaaaacacattacttaaactccgaatcacaaatattgatcaaatagctttggattctctcaaaactgcttctatggaacaggaggatgatataatcattcaagaaaccaatgataggctggtcttcaaagcaattcaagatgtgctaaaagaaaaactacataaaagaggtgttcgtattttgactggattgggaaaatattttcaacagttggacaaggaaggaaatggacttttagataaggcagattttaagcaagctctaaaagtgtttcacttagaagtgtctgaaaaggattttgagtctgcatggctaattctgaatgacaatggcaatggcaaggttgattatggagaattcaaacgtggtattattggtgaaatgaatgaatacaggaaatcatatgttcgaaaggcctttatgaaactggatttcaacaaaagtggcagtgtgcctattataaacataagaaaatgttactgtgcaaagaagcattctcaagtaatttcaggttgaccagcaaggacaaacatgaaaatgcttaaaaaaaagaaagcgcttaaaacaaagaaatagaaggtaatgggcatatataaaataagccaagcaagagaagagcaaagacaatctgcagggtggacatggatgtattcgtttctgatcatgagaagaggctcttgtcatacatatcgttccatttttattttaaagttctataaacttctgaggtaaactgatttcttggatgtacttaataaagaataaatgtttcatattgga

SEQ ID NO: 113438 - DNA, 599 bp, Homo sapiens
  Payload ID: 2175
  Gene Symbol: CAPS2
  Gene Name: calcyphosine 2
  ENST ID: ENST00000436898
  CDS Start-End: 195-599
agacctgcagagtgaagaaagctggtaatagatgtctgacaaactaaagaaagacttgtgttactatactgcatgataaacacaggaactcaaatggatttagaggttaaaggagttgctgccacttctaggagccaaattcagccattctttggaagaaagaagcctctacaacaaaggtggacttctgagtcatggacaaaccagaattcttgcccaccagtgatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtc

SEQ ID NO: 113439 - DNA, 559 bp, Homo sapiens
  Payload ID: 2175
  Gene Symbol: CAPS2
  Gene Name: calcyphosine 2
  ENST ID: ENST00000551829
  CDS Start-End: 459-559
agacctgcagagtgaagaaagctggtaatagatgtctgacaaactaaagaaagacttgtgttacggtcccacgacttgatttgggaagccttgttgactctgatgatgaggatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgac

SEQ ID NO: 113440 - DNA, 593 bp, Homo sapiens
  Payload ID: 2175
  Gene Symbol: CAPS2
  Gene Name: calcyphosine 2
  ENST ID: ENST00000552497
  CDS Start-End: 32-593
agacctgcagagtgaagaaagctggtaatagatgtctgacaaactaaagaaagacttgtgttacgatcagaacataatacctgaaaatttgccagcaccaacagacaaatgtaaactaaaatatcagcaatgtaaaactgaaattaaagagggctataagcagtatagtcagagaaatgcagaaaatacaaaatcaaatgttacacataaacagtctccaagaaacaagatagatgaaaagtgtgtgcaagatgaagaagccaacacagatgaccttacgactctggataggaaagccatcttacagcaaggttatgcagacaactcttgcgataaacaacagagggcaagaaaattggatgcagaaattgtggctgcagagaagaagaaacagattgttgcagagcaagtgatgatagaccacttatctagggctgtcatcagtgatccagagcaaaatttagccattgagcaaaaagaaagtgatcatatccttccagattcaaagatgacacctcttcgatttagaaaaagaacactacatgaaacaaagataagaactcattctacattaactgaaaatgtgctttctc

SEQ ID NO: 113441 - DNA, 969 bp, Homo sapiens
  Payload ID: 2176
  Gene Symbol: CAPSL
  Gene Name: calcyphosine-like
  Uniprot ID: Q8WWF8
  ENST ID: ENST00000397366
  CDS Start-End: 96-722
aaggtggcttgggagggaccagttttcctagatgcaggagacagcgtccatagtttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgt

SEQ ID NO: 113442 - DNA, 1004 bp, Homo sapiens
  Payload ID: 2176
  Gene Symbol: CAPSL
  Gene Name: calcyphosine-like
  Uniprot ID: Q8WWF8
  ENST ID: ENST00000397367
  CDS Start-End: 128-754
gagaaaaggcagaaccagagtagagattgacagtgagctgagccaatcaggctgtgaatctgcagcagtgatcccaggtcctccaattaatactaagagagtggaccagggcccctgaggaagacagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgcatccattgacactgatgtgtacttcatcatcatgatgagaaccgcctggaagctttaagcacatgacctggggaccaggccctgggacagccatgtggctccaaatgactaaatgtcagctcaaaaaccagaatcgtatttgatttcacactcatcctaatgtttttttctgtgtcaaaatattgcattttctggggccaaaaaacaggcagaaataaaagacattgagtagccaactgtgagtttgccttgcctaagactgtttcctttgttctaaaataggacttaaataaaatgagctctgtaaa

SEQ ID NO: 113443 - DNA, 656 bp, Homo sapiens
  Payload ID: 2176
  Gene Symbol: CAPSL
  Gene Name: calcyphosine-like
  ENST ID: ENST00000514524
  CDS Start-End: 96-638
aaggtggcttgggagggaccagttttcctagatgcaggagacagcgtccatagtttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtaagtaaaagagcctaatctaggggaaatttcttc

SEQ ID NO: 113444 - DNA, 665 bp, Homo sapiens
  Payload ID: 2176
  Gene Symbol: CAPSL
  Gene Name: calcyphosine-like
  ENST ID: ENST00000513623
  CDS Start-End: 96-665
aaggtggcttgggagggaccagttttcctagatgcaggagacagcgtccatagtttcagttcgaagcaactggtggcaaaaggttagcatttaagatggcagggacagcgcgccatgaccgagagatggcgatccaggccaagaaaaagctcaccacggccaccgaccccattgaaagactccgactgcagtgcctggccaggggctctgctgggatcaaaggacttggcagagtgtttagaattatggatgacgataataatcgaacccttgattttaaagaatttatgaaagggttaaatgattatgctgtggtcatggaaaaagaagaggtggaagaacttttccggaggtttgataaagatggaaatggaacaatagacttcaatgaatttcttctcacattaagacctccaatgtccagagccagaaaagaggtaatcatgcaagcttttagaaagttagacaagactggagatggtgttataacaatcgaagaccttcgtgaagtatataatgcaaaacaccacccaaagtaccagaatggggaatggagtgaggaacaagtatttaggaaatttctggataactttgattcaccctatgacaaagatggattggtgacccctgaggagttcatgaactactatgcaggtgtgagcgca

SEQ ID NO: 113445 - DNA, 4114 bp, Homo sapiens
  Payload ID: 2177
  Gene Symbol: CALD1
  Gene Name: caldesmon 1
  Uniprot ID: Q05682
  ENST ID: ENST00000361901
  CDS Start-End: 202-1818
ctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 113446 - DNA, 3612 bp, Homo sapiens
  Payload ID: 2177
  Gene Symbol: CALD1
  Gene Name: caldesmon 1
  Uniprot ID: Q05682
  ENST ID: ENST00000361675
  CDS Start-End: 230-2611
cctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcaggtagaggtgatggtggaagagaaaacaactgaaagccaggaggaaacagtggtaatgtcattaaaaaatgggcagatcagttcagaagagcctaaacaagaggaggagagggaacaaggttcagatgagatttcccatcatgaaaagatggaagaggaagacaaggaaagagctgaggcagagagggcaaggttggaagcagaagaaagagaaagaattaaagccgagcaagacaaaaagatagcagatgaacgagcaagaattgaagcagaagaaaaagcagctgcccaagaaagagaaaggagagaggcagaagagagggaaaggatgagggaggaagagaaaagggcagcagaggagaggcagaggataaaggaggaagagaaaagggcagcagaggagaggcagaggataaaggaggaagagaaaagggcagcagaggagaggcagaggataaaagaggaagagaaaagggcagcagaggagaggcaaagggccagggcagaggaggaagagaaggctaaggtagaagagcagaaacgtaacaagcagctagaagagaaaaaacatgccatgcaagagacaaagataaaaggggaaaaggtagaacagaaaatagaagggaaatgggtaaatgaaaagaaagcacaagaagataaacttcagacagctgtcctaaagaaacagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtcc

SEQ ID NO: 113447 - DNA, 4281 bp, Homo sapiens
  Payload ID: 2177
  Gene Symbol: CALD1
  Gene Name: caldesmon 1
  Uniprot ID: Q05682
  ENST ID: ENST00000393118
  CDS Start-End: 222-1898
aacgggttgggaggagtagatttggctgaggacaagcccagactttcgtcacagggacagaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaatgtctttttctcacttatttttatgtacaatattgatagtgagaggtatgtctattataataaagattatggcacagtaaaacctgt

SEQ ID NO: 113448 - DNA, 525 bp, Homo sapiens
  Payload ID: 2177
  Gene Symbol: CALD1
  Gene Name: caldesmon 1
  ENST ID: ENST00000445569
  CDS Start-End: 130-525
gtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagtgtctacacaaataactcatgcaacatgctgtatcttttgaaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcag

SEQ ID NO: 113449 - DNA, 2124 bp, Homo sapiens
  Payload ID: 2177
  Gene Symbol: CALD1
  Gene Name: caldesmon 1
  Uniprot ID: Q05682
  ENST ID: ENST00000424922
  CDS Start-End: 12-1610
caactgcggacatgctgggtggatccggatcgcatggaagacgcagcctggccgcgctctcccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtcttt

SEQ ID NO: 113450 - DNA, 1938 bp, Homo sapiens
  Payload ID: 2177
  Gene Symbol: CALD1
  Gene Name: caldesmon 1
  ENST ID: ENST00000430085
  CDS Start-End: 243-500
gtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtca

SEQ ID NO: 113451 - DNA, 2665 bp, Homo sapiens
  Payload ID: 2177
  Gene Symbol: CALD1
  Gene Name: caldesmon 1
  Uniprot ID: Q05682
  ENST ID: ENST00000422748
  CDS Start-End: 460-2151
gatttcctgagcatgcctagggaatgacaggcatctccacaggcaggctgcatccaccttggctggggtgtcgtcattggctgcctattagaaaaacgacaggacaatgcataccaccgcctcccgactgtaaacataggggatatgtgttcacttagcatggacttctgggaggggccaaggaagggcggtctggagttttattgaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtcttt

SEQ ID NO: 113452 - DNA, 1915 bp, Homo sapiens
  Payload ID: 2177
  Gene Symbol: CALD1
  Gene Name: caldesmon 1
  Uniprot ID: Q05682
  ENST ID: ENST00000417172
  CDS Start-End: 242-1858
atattcaagcctgctctcaggcctgaaatcttttgacttcattctcaggaggcaagactgggtctacctctagatgtctctgatgggatttagtgtgcagcttgaaatgcaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggc

SEQ ID NO: 113453 - DNA, 558 bp, Homo sapiens
  Payload ID: 2177
  Gene Symbol: CALD1
  Gene Name: caldesmon 1
  ENST ID: ENST00000454108
  CDS Start-End: 341-558
gaatagagcagtgtgtattcggctgcctgcctgcccgcctgcttgctctctggctgtgctcctgcttaaagaaatcagtccttcctttccgacttagtcctcgggaagaagtttcagactacaaggtatcattggaacatttcaagatcatcaaatcaaattccacagggattggtgaccaaccagaaggctcagacatctgattgctgaccttcctggatcaatcatgaagtcttcacttcctgtgaaaaatgctagtgacttgaatcaataaagacaacatgagtcagccttccaaggtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacag

SEQ ID NO: 113454 - DNA, 4173 bp, Homo sapiens
  Payload ID: 2177
  Gene Symbol: CALD1
  Gene Name: caldesmon 1
  ENST ID: ENST00000443197
  CDS Start-End: 164-1774
agaccaacgtgttaacacaaagggagaacacgggagcatcctgcaccgtgcatttcagccacagatcacatggcccctccgcgggcccagcccacgccctgaccgcccggcctggccaggtctccgtatctctctgccccgccgccccttcccaactgcggacatgctgggtggatccggatcgcatggaagacgcagcctggccgcgctctcccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctctgaccttctgttcctcactctttggtctctggttgattggaaacctgcttctcctgccttcatttctccctcttcttccggagtgggtctttctctaaaatgtagtctggtcaggacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtctttaaaaaaaaaaaagaaatgtactgttaaggtattactttttttcatgctgatgattcatatctaaattacattattatgttagctgacagtggtactgattttttaggttggttgttttgtggatttctttagtagtgatagtagcctgaaccacattttagataactcaattatgtatgtatgtgcatacacatatacaaacacactaatggtagaatgcttttttatgtgctagactattatatttagtagtatgtcattgtaactagccaatatcacagcttttgaaaaattaaaaaatcacactatattaatattttatatttgccaacagaaacatggcagataggtatcaatatgttttcaatgcctgatgacctataagaagaaagtattgaaaagaagagagattagaactgttagaaggagttgaaattttctaaaagacatagtatttagtttataattaaatgcattcttgaagtccagtgtgaattttattaatgctatcatctcgaccaagctcaaagcctacttattagaaacaatgaagttcacaataggtcataaggtctcttccttttctaaaattgaaagacaagaaatttagtgccaatattgtacagacagaaattccatgtatgagtctcaacaaagactacctttggctaaatgtctagaagcagagaagtaaagtgagcaaaatccagtgttgaggagtcatgacagtactttgatctttatatactctgaagcatttcttcaaacttttctacttttatttgtcattgatacctgtagtaagttgacaatgtggtgaaatttcaaaattatatgtaacttctactagttttactttctcccccaagtcttttttaactcatgatttttacacacacaatccagaacttattatatagcctctaagtctttattcttcacagtagataatgaaagagtcctccagtgtcttggcaaaatgttctagtatagctggatacatacagtggagttctataaactcatacctcagtggacttaaccaaaattgtgttagtctcaattcctaccacactgagggagcctcccaaataactattttcttatctgcagtattcctccagaagagctaaccagggcagggctggcatgagaagtgacatctgcgttacaaagtctatcttcctcataagtctgtaaagagcaattgaatcttctagctttagcaaacctaagccaaaggaaggaaagccatgaagaatgcagaagtcaaaccctcatgacaaagtaggcacaagtctacaataagctaaatcagaatttacaaatacaagtgtcccaggtagcattgactcccgtcattggagtgaaatggatcaaagtttgaattaaggcctatggtaaggtaacattgctttgttgtacttttgaacaagagctcctcctgatcactattacatatttttctagaaaatctaaagttcagaagagaatgtatcactgctgacttttattccaatatttggatggagtaagttttagggtagaattttgttcagtttggatttaatcttttgaaaagtaaattccttgtttactggtttgactataattctctgttatctttacgaggtaaaactgcaagctgactagcatgttctgtgaatctgccattcctaaaaattttataaacacttgatacttttcactgataatggatcgctccaataaacatatattgtgaaaatgcatccacaataaatggaattccttcctgcaaaa

SEQ ID NO: 113455 - DNA, 1614 bp, Homo sapiens
  Payload ID: 2177
  Gene Symbol: CALD1
  Gene Name: caldesmon 1
  ENST ID: ENST00000436461
  CDS Start-End: 236-1614
aagaattctggattaaactccctcccttgcattgtattcaggggtgccttccttgaagaattgaaagcagaaagatttgggagctgagagttaagctgaacaaaaggtatcattggaacatttcaagatcatcaaatcaaattccacagggattggtgaccaaccagaaggctcagacatctgattgctgacctgtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagcagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtat

SEQ ID NO: 113456 - DNA, 458 bp, Homo sapiens
  Payload ID: 2177
  Gene Symbol: CALD1
  Gene Name: caldesmon 1
  ENST ID: ENST00000435928
  CDS Start-End: 241-458
aaccactgacagctctgtaaacaaagcaaggacaaaaagagcccgcttccccctttctggtagtcattttgggtttgggggctgcaggggaattctggaatacttgactccatggcacagaaacgcaggggaaacgggctcctcatttaaagagctggaaggggaaggtctttccggaattaaaaccatcacagaggaggtccagacatcatctggtctccctgaacctgaaatcacaccatggatgattttgagcgtcgcagagaacttagaaggcaaaagagggaggagatgcgactcgaagcagaaagaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacag

SEQ ID NO: 113457 - DNA, 2199 bp, Homo sapiens
  Payload ID: 2177
  Gene Symbol: CALD1
  Gene Name: caldesmon 1
  ENST ID: ENST00000495522
  CDS Start-End: 12-1685
caactgcggacatgctgggtggatccggatcgcatggaagacgcagcctggccgcgctctcccaaatcgcctaccagaggaatgacgatgatgaagaggaggcagcccgggaacggcgccgccgagcccgacaggaacggctgcggcagaagcaggaggaagaatccttgggacaggtgaccgaccaggtggaggtgaatgcccagaacagtgtgcctgacgaggaggccaagacaaccaccacaaacactcaagtggaaggggatgatgaggccgcattcctggagcgcctggctcggcgtgaggaaagacgccaaaaacgccttcaggaggctctggagcggcagaaggagttcgacccaacaataacagatgcaagtctgtcgctcccaagcagaagaatgcaaaatgacacagcagaaaatgaaactaccgagaaggaagaaaaaagtgaaagtcgccaagaaagatacgagatagaggaaacagaaacagtcaccaagtcctaccagaagaatgattggagggatgctgaagaaaacaagaaagaagacaaggaaaaggaggaggaggaagaggagaagccaaagcgagggagcattggagaaaatcagggagaagagaagggaactaaagtgcaagctaaaagagaaaagctccaagaagacaagcctaccttcaaaaaagaagagatcaaagatgaaaagattaaaaaggacaaagaacccaaagaagaagttaagagcttcatggatcgaaagaagggatttacagaagttaagtcgcagaatggagaattcatgacccacaaacttaaacatactgagaatactttcagccgccctggagggagggccagcgtggacaccaaggaggctgagggcgccccccaggtggaagccggcaaaaggctggaggagcttcgtcgtcgtcgcggggagaccgagagcgaagagttcgagaagctcaaacagaagcagcaggaggcggctttggagctggaggaactcaagaaaaagagggaggagagaaggaaggtcctggaggaggaagagcagaggaggaagcaggaggaagccgatcgaaaactcagagaggaggaagagaagaggaggctaaaggaagagattgaaaggcgaagagcagaagctgctgagaaacgccagaagatgccagaagatggcttgtcagatgacaagaaaccattcaagtgtttcactcctaaaggttcatctctcaagatagaagagcgagcagaatttttgaataagtctgtgcagaaaagtggtgtcaaatcgacccatcaagcagcaatagtctccaagattgacagcagactggagcagtataccagtgcaattgagggaacaaaaagcgcaaaacctacaaagccggcagcctcggatcttcctgttcctgctgaaggtgtacgcaacatcaagagtatgtgggagaaagggaatgtgttttcatcccccactgcagcaggcacaccaaataaggaaactgctggcttgaaggtaggggtttctagccgcatcaatgaatggctaactaaaaccccagatggaaacaagtcacctgctcccaaaccttctgacttgagaccaggagacgtatccagcaagcggaacctctgggaaaagcaatctgtggataaggtcacttcccccactaaggtttgagacagttccagaaagaacccaagctcaagacgcaggacgagctcagttgtagagggctaattcgctctgttttgtatttatgttgatttactaaattgggttcattatcttttatttttcaatatcccagtaaacccatgtatattatcactatatttaataatcacagtctagagatgttcatggtaaaagtactgcctttgcacaggagcctgtttctaaagaaacccatgctgtgaaatagagacttttctactgatcatcataactctgtatctgagcagtgataccaaccacatctgaagtcaacagaagatccaagtttaaaattgcctgcggaatgtgtgcagtatctagaaaaatgaaccgtagtttttgtttttttaaatacagaagtcatgttgtttctgcactttataataaagcatggaagaaattatcttagtaggcaattgtaacactttttgaaagtaacccatttcagatttgaaatactgcaataatggttgtcttt

SEQ ID NO: 113458 - DNA, 1941 bp, Homo sapiens
  Payload ID: 2178
  Gene Symbol: CCIN
  Gene Name: calicin
  Uniprot ID: Q13939
  ENST ID: ENST00000335119
  CDS Start-End: 110-1876
tctccctggtcaaccgctctgcaaacaaccatcaatctgatcccacaggcctgagaaagtctgctctccagtacctgctgctgatctgtttcagccgacaagaggcaccatgaaattggaattcacggagaaaaactacaatagcttcgtgctgcagaacctgaacagacagaggaaacgcaaagagtactgggacatggccctgagtgtggacaaccacgtcttctttgcacatcgcaatgtgctggctgctgtctccccactggtgaggagcctcatctccagcaatgacatgaagaccgctgatgagcttttcatcaccattgacaccagttacctgagcccggtcacagtggaccagcttctggactacttctatagcggcaaggtggtgatctccgagcaaaatgtggaggagctgcttcgtggggctcagtatttcaacacaccacgccttcgagttcactgtaacgacttccttattaagtccatctgccgtgccaactgcttgcgctacctcttcttggctgagctgtttgagctcaaagaggtatcagacgtagcttactctggcattcgggacaacttccactactgggccagtcctgagggctccatgcacttcatgcgctgtccacctgttatctttggccgcctgctccgtgatgaaaaccttcacgtgctcaatgaagaccaggcgctcagcgcactcatcaattgggtgtacttccggaaggaggatcgggagaagtatttcaagaagttcttcaattacatcaatctcaatgctgtctccaataagacgctggtgtttgccagcaacaagctggtgggcatggagaacacctcatcccatacaaccctgattgagagtgtcctgatggaccgcaagcaggagcggccatgcagcctgctggtctaccagcggaaaggggccctgcttgattccgtggtcatcctcggtggccagaaggcccacggccagttcaatgatggagtgtttgcttatatcatccaggagaacctgtggatgaagctctcagacatgccctatcgggcagcagcacttagtgccacctctgctggtcgctacatctacatctctggtggcaccactgagcagatttcagggctgaagacagcctggcggtatgacatggatgacaactcctggaccaagttgcctgacctgcccatcgggcttgtcttccacaccatggtgacctgtggggggacagtgtactcagtgggcgggagcattgccccaaggcggtatgtctccaacatctatcgctatgatgagcggaaggaagtctggtgcctggcaggaaagatgagcatccccatggatggcaccgccgtgatcactaaaggagacaggcatctgtacattgtcactggacggtgcttggtgaaaggttatatctcccgggtcggggtagtggactgctttgacaccagcactggggacgtggtccagtgtatcaccttccccattgagttcaaccatcggcccctgctctctttccaacaggacaacatcctctgcgtgcacagccaccggcagagtgtggaaatcaatctgcagaaggtgaaggcaagcaagacgaccacctcagtgcctgtcttgcccaacagctgccccttggatgtgtcccatgctatatgctccattggagacagcaaggtgtttgtatgtgggggtgtcaccactgccagcgatgtccagacaaaggactacaccatcaatccaaatgccttcttgctggaccaaaagacaggcaagtggaagaccctggctcctccaccagaggcactggactgtcctgcctgctgtctagccaagctaccttgcaagattcttcaaaggatttaaacattttaagtgggagaataagtaaatgcattattattcacgatttaatgagagaaagagaggaa

SEQ ID NO: 113459 - DNA, 3043 bp, Homo sapiens
  Payload ID: 2179
  Gene Symbol: CLGN
  Gene Name: calmegin
  Uniprot ID: O14967
  ENST ID: ENST00000325617
  CDS Start-End: 442-2274
taatcttgctgcacttattactggacgttgttcataaatatgatttacataaaattcaggacccaatcattgcgcaacaggaggtagcacggtctgcagagagggcgggagctcagaggaggaaaagtcttcggacttgcagggggaattcctcctgggctaacccgggagcggggtccaggccacaaccggccggcggcggcacaggctccatgtgcggctccccctggaggcggttgagcccctcggagcaggagcgcgtagcacacacctcgggccgccaccgcctcccgcccgccaccgcacgcgcacgcgcggttagtagtcgctgctgcgcggccgccggcgggactggtctgaagagacgcggggaccaagtggcaacgacttggacatctgagctgtcactgccgaaaacaggccgcaagagagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctg

SEQ ID NO: 113460 - DNA, 2820 bp, Homo sapiens
  Payload ID: 2179
  Gene Symbol: CLGN
  Gene Name: calmegin
  Uniprot ID: O14967
  ENST ID: ENST00000414773
  CDS Start-End: 219-2051
cgcacgcgcggttagtagtcgctgctgcgcggccgccggcgggactggtctgaagagacgcggggaccaagtggcaacgacttggacatctgagctgtcactgccgaaaacaggccgcaagagagcatctgcccaagcaacaaagaggaggtgtttgcttgggagttaaaagcaaatggcaaccaaagctcaggactgggagagaaaagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtttggaccagataaatgtggagaagattataaacttcattttatcttcagacataaacatcccaaaactggagttttcgaagagaaacatgccaaacctccagatgtagaccttaaaaagttctttacagacaggaagactcatctttatacccttgtgatgaatccagatgacacatttgaggtgttagttgatcaaacagttgtaaacaaaggaagcctcctagaggatgtggttcctcctatcaaacctcccaaagaaattgaagatcccaatgataaaaaacctgaggaatgggatgaaagagcaaaaattcctgatccttctgccgtcaaaccagaagactgggatgaaagtgaacctgcccaaatagaagattcaagtgttgttaaacctgctggctggcttgatgatgaaccaaaatttatccctgatcctaatgctgaaaaacctgatgactggaatgaagacacggatggagaatgggaggcacctcagattcttaatccagcatgtcggattgggtgtggtgagtggaaacctcccatgatagataacccaaaatacaaaggagtatggagacctccactggtcgataatcctaactatcagggaatctggagtcctcgaaaaattcctaatccagattatttcgaagatgatcatccatttcttctgacttctttcagtgctcttggtttagagctttggtctatgacctctgatatctactttgataattttattatctgttcggaaaaggaagtagcagatcactgggctgcagatggttggagatggaaaataatgatagcaaatgctaataagcctggtgtattaaaacagttaatggcagctgctgaagggcacccatggctttggttgatttatcttgtgacagcaggagtgccaatagcattaattacttcattttgttggccaagaaaagtaaagaaaaaacataaagatacagagtataaaaaaaccgacatatgtataccacaaacaaaaggagtactagagcaagaagaaaaggaagagaaagcagccctggaaaaaccaatggacctggaagaggaaaaaaagcaaaatgatggtgaaatgcttgaaaaagaagaggaaagtgaacctgaggaaaagagtgaagaagaaattgaaatcatagaagggcaagaagaaagtaatcaatcaaataagtctgggtcagaggatgagatgaaagaagcagatgagagcacaggatctggagatgggccgataaagtcagtacgcaaaagaagagtacgaaaggactaaactagattgaaatatttttaattcccgagagggatgtttggcattgtaaaaatcagcatgccagacctgaactttaatcagtctgcacatcctgtttctaatatctagcaacattatattctttcagacatttattttagtccttcatttcagaggaaaaagaagcaactttgaagttacctcatctttgaatttagaataaaagtggcacattacatatcggatctaagagattaataccattagaagttacacagttttagttgtttggagatagttttggtttgtacagaacaaaataatatgtagcagcttcattgctattggaaaaatcagttattggaatttccacttaaatggctatacaacaatataactggtagttctataataaaaatgagcatatgttctgttgtgaagagctaaatgcaataaagtttctgtatggttgtttgattctatcaacaattgaaagtgttgtatatgacccacatttacctagtttgtgtcaaattatagttacagtgagttgtttgcttaaattatagattcctttaaggacatgccttgttcataaaatcactggattatattgcagcatattttacatttgaatacaaggataatgggttttatcaaaacaaaatgatgtacagattttttttcaagtttttatagttgctttatgccagagtggtttaccccattcacaaaatttcttatgcatacattgctattgaaaataaaatttaaatattttttcatcctg

SEQ ID NO: 113461 - DNA, 706 bp, Homo sapiens
  Payload ID: 2179
  Gene Symbol: CLGN
  Gene Name: calmegin
  ENST ID: ENST00000509477
  CDS Start-End: 168-706
gaagagacgcggggaccaagtggcaacgacttggacatctgagctgtcactgccgaaaacaggccgcaagagagcatctgcccaagcaacaaagaggaggtgtttgcttgggagttaaaagcaaatggcaaccaaagctcaggactgggagagaaaagataatcaatatgcatttccaagccttttggctatgtttgggtcttctgttcatctcaattaatgcagaatttatggatgatgatgttgagacggaagactttgaagaaaattcagaagaaattgatgttaatgaaagtgaactttcctcagagattaaatataagacacctcaacctataggagaagtatattttgcagaaacttttgatagtggaaggttggctggatgggtcttatcaaaagcaaagaaagatgacatggatgaggaaatttcaatatacgatggaagatgggaaattgaagagttgaaagaaaaccaggtacctggtgacagaggactggtattaaaatctagagcaaagcatcatgcaatatctgctgtattagcaaaaccattcatttttgctgataaacccttgatagttcaatatgaagtaaattttcaagatggtattgattgtggaggtgcatacattaaactcctagcagacactgatgatttgattctggaaaacttttatgataaaacatcctatatcattatgtt

SEQ ID NO: 113462 - DNA, 12747 bp, Homo sapiens
  Payload ID: 2180
  Gene Symbol: CLMN
  Gene Name: calmin (calponin-like, transmembrane)
  Uniprot ID: Q96JQ2
  ENST ID: ENST00000298912
  CDS Start-End: 115-3123
gactccagctccgcggcgccctcgccgggtgcgtgccgctcgcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaacgagaaagtatggcgtggcggtgcaggactttgcgggcagttggaggagtgggctggctttcctggcggtgatcaaggccattgaccccagcctggtggacatgaaacaggccctggaaaattccacacgagaaaatctagagaaggctttcagcatcgcacaggatgccctgcacatccccaggctcctggagccagaagacatcatggttgacacaccagacgagcagtctatcatgacttacgtggcacagtttctagaacgttttccggagttggaagccgaagatattttcgattcagataaagaagttcctatcgaatccacttttgttcgcatcaaagaaactccttctgaacaggagagcaaagtcttcgttctgactgaaaatggggagcgtacctacactgttaaccatgaaaccagccacccaccaccctccaaagtctttgtctgtgacaagcccgagagcatgaaggaattccgcctggatggtgtttccagccatgcgctgtcagacagctccaccgagttcatgcaccagattattgaccaggtcctgcaagggggcccaggtaagaccagcgacatcagtgagccatctccagaatcctccattttatcatccagaaaggagaacgggaggtccaactctttgccgatcaagaaaacagttcactttgaggctgacacctacaaggatcctttctgcagtaagaacctgtccctttgctttgaagggagcccaagagtggcaaaggaatcattgaggcaggatggacatgtcttggcagttgaggttgctgaggaaaaggaacagaaacaggaatcctcgaagattccagaatcctcctctgacaaggtcgctggtgacatttttttggtggagggcacaaacaataattctcagtcttcttcctgtaatggtgctttagagagtacagcccgccacgatgaagaaagtcactctctttcacccccaggagaaaatactgtgatggccgattccttccagatcaaggttaacctgatgactgtagaagctttagaggagggagactattttgaagccatcccattaaaagcctcaaaatttaacagcgacctaatagattttgcttctaccagccaggctttcaacaaagttccttcacctcatgagacaaaacctgacgaggatgctgaggcttttgagaatcatgctgaaaaactaggtaaaaggagtattaaatctgctcacaaaaagaaggattcgccagagcctcaagttaagatggacaaacatgaacctcatcaggactccggagaagaagctgaaggctgtccttcagccccagaagagacaccagtggataaaaagccagaggtgcatgaaaaggccaagagaaagtccacccgtcctcattatgaggaagagggagaagacgatgacctccagggtgtgggcgaggaattatcttccagccccccaagcagctgtgtcagcttggagacccttgggagtcacagcgaagaaggcctggatttcaagccctccccacccctctcaaaggtttccgtcattccccacgacctcttctatttcccacactatgaggttcccctggctgcagttttggaggcttatgtagaagacccggaggatctaaaaaatgaagaaatggatctcgaagagccagagggctatatgccagacctggactccagggaggaggaggccgatggctctcagagcagctccagttcctcggtgccaggagagagcctccccagtgccagcgaccaggtgctgtatctcagcaggggtggtgtgggtaccacaccagcctcagaacccgctccactggccccccatgaggaccaccagcaaagggagaccaaagagaatgaccccatggacagccatcagtcccaggaatccccaaacctggaaaacatagcaaaccccctagaagaaaatgtaacgaaagaatcaatcagtagtaaaaaaaaggaaaaaaggaaacatgtggaccacgtagaaagttcactatttgtagcaccaggaagtgttcaatcctcagatgacctagaagaagacagtagcgactacagcattccttccaggactagtcacagtgactccagcatttaccttcgacgacatactcataggtcttcggaatcggatcattttagctatgttcagttgaggaacgcagcagatctggatgacagaagaaaccgaatattaaccaggaaggccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggaccctgaccaggggcggggttacttcattttattttgggttctgggtggggcacttctacagacagttgaggacctccgaggaaacttagaccccctttctcgctattgtggtttttttttttttttcaggtttccttttttttctggacaacctgagcatgcttttttctttggctgtgtactcaaaactcaggcatgcagctggatccgtaggtggggttttgtccttgtgtgccttgctgggttggatagggagcattgttagtgatcattagcccgcctggatcttagcacaccccacattgcaggttcacacgctggatgaacttgagtttcttacctctcagatgaagggctgcttaatgagaaagagggtgggcaccccaggccaagccccagctggggagagagctgccacgttttcctccaagcgtgggtgtttgagagaaggtgctggggtccatgcacctgtcgcagtccggtaactggttgcattcactaggggaaatccgagcagccagctctgtgtaagcacatccaggaatggcagaatccagggaggaaggtgaaagctgtgttgagagccactgtgtgctctttttcaccctgttttttttgttgtttttttgttttgttttttgtttgaggggagataacacttgaaattcagttttccattgattggattgagatagaaccatgattttcaaaccagatcgccagggcccagcagggccatataaaagccatgaggagtggctgggctggaatcagctcccagcagtgctggagctgggtggtggggtagcttcctgcccactaaagctttggtgcacacctccctcagaatgcatgtcttggaacgggcattctttgtggtcacttgtaatgggtttcttgaagaggctttctggacagcactccgggagcaggccagcacaggaggtttgtgaaagaagagaggcatctctagcacccctgcccccagtcttcctcagccccaggctccctctgctctctcctccctgccaagactcaggtccgtggtgagtctctgcattggttcctcctccccttgctctccccttcagaaagcatgtaccaggcaacccttataaaatcacaaatgagtcaggaggggactcagtgagcatcttgtctagctggacccagagagacagagcagcttgaccaagatcatatagccgaccaggggcagacttgcagtgagcacacaggcacctgatgccctgtccagagctgtcaccccttgtaggaaacttccactgggcacaccaatgtcctgagaaaaagataaaatgactagattaaaatgtccacattcaagcaaaaccaaaaagtttagaccaactatcgacatttgttttgttcttgtatttttcccatgaggaattcttactcaccttcaagctcatccccaattccttctgaaatacccttgacagctgcaacagcttgtcatttgacataccagcgtcgctcttactccaggaatcacgtttctttctttgctagccaaggacttgctcatttcaagcagtgggtttcaagtttacagaattccagcatggccagaagaatttacatagcacatctgagtcgatgacagccaaaatctggcctctaaaccagtctgattatagtctgtctcccctcctgaaagaatttcagccttccaaccagaaagctgctgggagcttggagtgattccatctggaaggccaagagccccatggaaaatgagctaattaatgagctccctggcatcaatgaaagctcaaaggtacagataataaagattatgtgatagtttataactctgggcaccatgcagtccttgcctaaattagatgctcgaagagcctgggaagagccaacccaaatgtgaatcatttcattttatgggtctagaccttgttcagaaaaacctctgcaagatacttctctcacctattacaacttgtaatattgtttaaaacatctactggcaagatgcctgaaagtcatttggttcaggttggcagtcaactgatattttgcaaaggaaaaaaaaatctcatttgagtataggcttctatggaagaagctggatatagaaaatggatgtggaagtctgcaggacaaaccaccccattgcttgtaaattttttttaaattaaaagaaatacaataaggcttttaacaagaactagcagtcccctaagtctcgctgcttagaagtaaccactttcaactctcttatgtttgcatttctacataacgtgcttacactttattttttaatttagaaacatctactggcttgctgtcacagtagaggaggatttcactcttaccataccgtgctttggttttccagtatagctagatcacatcatttagtacatttctattaggtgttgacattacctggagcacttaaggattgttgactcccaagcccagcagtgtgttatggttacatgtcctttctcctccaaatgtccccattaatttgctattctctctctttactttttttttttttttggtgtggcacattctttaataacttcctgaggaagagaacatgggaagtaaatatggttgtaaatattttgagatttttgcatgacttaagatgtctgtattctgcccttaacagaaatgtggctgagcatagaatgacaggtggaaaataataccctcccctagcccctcccaagcgtgctggttgagatttctgatgccattctgattcccgtacctttatatgtgacttaggtttttttatccacccttcctggaaacatttaagatctctttattcttggtgttctgaactgtcatgatggtgttgtatcccgggtgttaaaccttgtgctgggccttcatgggaaatttcttaaattttcttgtgattatttacattctttctttctggaccacctattatttcaatgttggaccctcccctacacccaggctgatgctctaatattttttatcttttctatttttcgtctatgtttctgatctgctttcaggaagaattattcatttttatcttcccaatctgaatgttttattgaatttttattttccaagttaataaaacctttggttattatcctgtctttgttttacagtgtcctgctcttgatgcgtggatgcagattttgtctctctgtggacgttaatgattgtggtctgaggggaagtcttttctgctccctgtgttgccctcattttctctgagttctctttattttggtggtctcagtctctatctttcacgttgtgaatttttctcaaatatatggtgatcctatggatctgttcatgttttaagagtgaggcatccaaaagctgattggaagttgtgtgtgccaactggtgagcttttccactagggtcaccaggtgggcacctggactcatcattggagaacactgcctgtcagtatttgcacgtgttttctctggggctcattctgtttcttgagagatattcccactactctccttcctgggaaacgggcatacacagggcttttagcctatgctgagtactcatgtggtttcaaaaatggtgtcccatctgggcagaagtccccatgagcacttggcttgactggcaaaggacaccttttgccccttcctccagacatacccagctctgagcttggacaatgctcgaggaacaatgaaaaggctagattttaactcctaattgccctctttagccaagtgcctctgtgcaatgcacaactgtaggaccatatccagagaccctggtctatactcagtgtgcccgagtcctgaccgctgagcaggcagcctcatcacccgtgagtatttagactttcattaagttgcttcaacctttgctgtgcctggtgtccctgagttggagctgctctgatttctccatggagtaggagcacagtggtcatctggctgcatgggaaggacaggggacctcagagccaataaatgccctggtcttcagccccatgtctcaccccatccctcctattccaatccccaagcctctcctggaggccacagggcatctctgctgaccactctgtggcctcccctctgcaggcatgtggttttaggatccccctccctgctcacttttccatcagttccattcctgcataaataggttgctagctcttgcttactgttctcttctgtattctgtgttcatggttgtattaatataactttcattcctctgctcctattttcatggggtttcatgagggaagaaacaggctcatgtgttcagtataccatcttgatccataaaccccatttgagttatctcacaggttgcttagggggcttgctgctctgactggtttgtgaacgtgccctgagtccagctgggactgcagcaacatccatcctgttgagctgtggtctgctaagtgattttgtgtaatgctgtgccaagtgcaggagagggatacatagcatggctaagctctgcttgaatgccatgattagttattaccttccttccttccccctggttttgctgcctattgtcagtaaatgatcttagatctcctgcctccccaaagatatagtctatgtggtggtctgggttctaggttttctttaccacccttgcttcacttaagaaacagaaaactggctaggcacagtagtggctcacacctataatcccagccctttgggaggccaaggcaggaggatcgcttgaggccaggaattcaagaccagcctgcacaacatagcaagactccatctctacaaaaagttaaatttaaattagtggtggcatacacttatagtcccagctactcaggaggatgaggcaggagaattgtttgagcccatgactttgaggttactgtgagctatgatcctgctattttactccacctgagtgacagagcgagacgctgtctcaaaaataaagaaacaagtagtccacacaggtgtttgccagcaaacaaacagcgcggattctctgttgaacgtggccaacattgcctcgtcgaagtttgtatcttgccatagttgatgatcaggtggtcggggcttcctggtcagacctgacctttgtggggagatgttctcccaccaaggctcagaagcaggacactcttgctgcccctcgggcagccacccagaacatgggcgtctccatttctgaggttcagcatagttccccccaccctcttcccatgcagtgcatgcctgctctttatcaggatggaacagagggaaggcagaggcactgggggcagcctgtgttgttgatctctgtaagtcacagactgttcgaaaacctcaggaattatgtaagcgttcagtgcctcatttaagagatgaaaaactgaagattagaaagaggaaacgactagtcgccctgctagttgatgacctccagatagccatcttcattcccagttaagtttactacaaaaccacagcctcagctgctgaagctaacctccctacccaccatcgctagggactcagaacaccatggagctcatctctccaacaaaagtcagaattagcaagtacagatgtgtcttacgaaaatgtcagaatccatcatggctgctttggtgaggagctgttctccttccgtggtcatgccattggaaggcagttgtatgacaagaatgctttcacatgagctccgattttcttaactctccagaaggacttcagaagcctctggagttttgagacacggcctctctctcccttctgcttggagacaccttcctgggggtctccactgcattccccgccggtattcctctgtggagccttgcgccctcaggtcccagaaatgggctgtgtgggagcttccagtcagcctggtatctcgggaccttctcagccaggaaatgagactgcacaaagccctgtgaggcccagctgtgttatttctccttccccgacattgcataatcactgctgacacagcatttggggaagatttaacgtcttgggccagcagctgccatctggaaccatcaccacatagcaggttgttctgtcccatccaactgatgagggggctgccctaatgacaaggtccaggacctgggttgggtggtggaaggctgggagctggagtgggcattattgtgcttctgtgctgaaaattgctatggctcttttcccctaacagccagcgtgggagaaccaaacatgagacacaagcatccccttgagctccacagatcttgcgccttgctctcatcaggcatttccttggaaaacagcagtcagcagctcatggaagtgagcccggtgcacagactttgcatggactttgcacaggttccatttccatcgtgtgcagacacctgtatctttgggctccacgtgagcacctgccctcttcactctgattttttttttaagagacagcatcttactctgtcaccgaggctggagtacagtggtgtgatcacagctcactgcagcctgaaactcctgggctcaggcaatcctcctgcctcagcctcccaagtagctggtagtacaggtgcatgccaccacgcccacctaatttttttatcttttatagatacaggtctcactgttgctcaggctggtctcgaactcctggcctcaagtgatcctcctgccttggcctaccaaaatgctgggattataggcatgaaccactgtgcctggccttcactctgatttttcttaagagtcctacaggaccttcaggtcttgtcacttctctaccattgtgtgtgagacagggcatggggtgagcttggtcaggtgtgggtcaaaagcctggagactcagagctgctggttccccaagagcccacaaaagttatcagagtttctgagctgagtgttctgcagttgccagaccccacaatgctgggaatactggcttctttgtgtttagaacttgttctgagaaccttgatgagaacacatcaagcaagcagttcctcccagccagggctggagcaacatgccaaaaaacattcttgtctatgggaaaaagacaaccagtattttgtactgtttgaccaagttgtttttaaatatacacatgcctcaacaatccacggcctcaatcgcactgctaatttgtttaaatccctgacactcagatgtcaagaatagcttcatctagcagtgttctctttaaaggaacccttttttttgttttcattttaatcactgccttcttctctgggaggtattgtgggctagagaaagaagtcaggtttgggagtcagccagatttagattggagtcccagctctgtcaccagatctctgggtgatcttggcaaactaacttctgagcttctgtgcattataggcattcagcacatatttgttggatgaaaaatacttttcttgaaagtttatgaagttgtaggatgcccagcagcccccttttctctatttccttcctcttgaagcaagcgttgactatacctctttccctaacccttagtgtaccatagcttcttccaacctctctccaatccattacttttttctgagctaccctgtctcaaatctaactcaggcctttttgcaagaggaagtttaagccattgtttactcattaactcacttgacccttagaacaatcgtgggaggtgtttatttcggaaaggaagctaaagcacaggacagaaaaataaggtcatagcgtgaactagtaagtagcagaactgggaacataggactgttattttcaaacactctaaacttcactgcagttgcaaatttgcaaccaaaatggccgccttgaaagggtcttttgcagtaaaatctcagtgtccaacatcaaagacagttcttcagggcctccaattaactatacatcctgcccccagctgctcatctctgcacctctaacacgtacttcacagagtaggaaattgggctttctccttcaaaaagaaaagtagagaaggcctgagggcagtgtaattaaaatggagaagtagagaccacgaattacttggatgaattcataactggttggtctctgaggcagggattattatttttcctgtattttaagcttaaaagtagtgatttttgcattgttacaaaaaacaaaatagcaaaatatcatttgatacttgtattctgtttgcaatagctaccacttcctttagccccagcaaaaatcaataggtgtgtattctctacaagcccatgctgtgccagaatgccagtattgctaaatgtcatgcaaggatttagacacttttttaaaggaaactctgggagtgcctgttgtctggagagttgacattgtccaaagcaggccaacactggtatgggtatggagaacccacgtcctagctgtggctcacctgcagatgccttgaatttacctctctgggttggaagtgggaagacttcttttaaaagtcctttctaagtttaaaaatccaaaggttacgaaggtagtttttatttatctcaataagtggcctatttgcttaaagcaagtgtacctctgtatatcagcccaaagcttagggcagtgcttcttggctttagtatctgagaaaggtgcctttgggaagagtttggtcagacagaaggtagtctgaatcttaaaggtttcagatgaatgtttgaagtagaacctgggaaatctgcttcctagggctgttagaaggaaattggtctccttaaattacgtcagcatctgaggcagtttcctaagggaatttcttttaaattcaaaagttcaactgcaggaataaatagctgtacaggactagatcttcccatccctcatcttttccccttccccgagtaacgactcaaaaaggcttctgaaattctactcagaatcggagccgtttgcattccaacaaggatcccttaagccaaatgctggtgtgtttgtgtagaatgtccctggggtaggggcggtagctgtggggagggaatgtggtgcaggggacacctgccctctgcccttgaaattgcaccataagatgctgcctatgtcactcacagtggtgctgatactatccgccaaagacaaattgtgaacacggaaaaatggtcgttccctactgtacatcctcaggacagacttaactaaacttggagacaggagattgttcagaccatattgtagtgggtggtgatcattgttttattttgggggagtctggtctattgagcagattgaatgtttccttattgtgcagggcttaattgactatgtctgaaagtttttactgagagctctaagaaaactattgaggaaaatgaaatgttattttgtagtacaaggattatttttgtctatttaggatatacatagctgtagctttgtaaaaaaaaagatctttataaacaatatatgaatgtgccgtcttatttattgattactgtaaattaagatataaatggctatttgaataatttatacctgtgggaattaactggagtatttgttatttgactgttttctattaaggaatattaggcttggtgctatgatgaatgatcttgtaaaatcatgtgtattcttaagaaaatttttgaatataaatttcttgaactga

SEQ ID NO: 113463 - DNA, 565 bp, Homo sapiens
  Payload ID: 2180
  Gene Symbol: CLMN
  Gene Name: calmin (calponin-like, transmembrane)
  ENST ID: ENST00000553733
  CDS Start-End: 87-380
gtgcgtgccgctcgcgcgcccgccagccaggctctccgcgcccgccgcccgcgccgcgctggcccgggctctcccgcccgcgcttcatggctgcacacgagtgggactggttccaacgcgaggagctcatcgggcagattagcgacatccgagtgcagaacctgcaagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgagccctggtcaccagctgctgtgtccttggtgggcctccacggggagtctttgattctggagcccagccaagaacaggcctccacttccccatgagcgtggcctggcacttcacacctggtggagctgacccactggtttgccttgtaatgccatcttcccccaacctggaggagcgtcagtgtgcttcagttcaggctgcacgaatacaaatcctcgtcgcatcgtatttttcggttg

SEQ ID NO: 113464 - DNA, 718 bp, Homo sapiens
  Payload ID: 2180
  Gene Symbol: CLMN
  Gene Name: calmin (calponin-like, transmembrane)
  ENST ID: ENST00000555336
  CDS Start-End: 321-718
cccccttcctctctgtcttgtgtggtctcttgcccttttgccttccactatgggatgatgcaccagcagattccagtgctgtgttcttggactgcccagcctctagaaatccttctgttattgtgtgtcaaaatcacaagctccctgaagactaaggatgtgtctaagataacgtctccactcatagcaggcaatattttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttcccacccacacccactgcagagaggagcgtggcaatatcggtgaaagaccagaggaaggctatcaaggccctgttggcgtgggtgcagaggaaaac

SEQ ID NO: 113465 - DNA, 452 bp, Homo sapiens
  Payload ID: 2180
  Gene Symbol: CLMN
  Gene Name: calmin (calponin-like, transmembrane)
  ENST ID: ENST00000556441
  CDS Start-End: 216-419
taaaaacgcacccaaaacgcctcacctggaccccgcgcgcacccagaaggatcacgttcagagacagaggtgcaacatgagtcaaggatcattttagctatgttcagttgaggaacgcagcagatctggatgacagaagaaaccgaatattaaccaggtacagtactcagaagcttactgagctgattttacagttttatggcatcagagcagacatgaagagggaaagcaaacatgccaggatgtctatgaaagccaacagctcaggagaagccatgtcactggggagccacagcccgcagagtgactccctgacacagcttgtccagcagccggatatgatgtattttattctcttcctgtggctcctggtgtactgcttgctgctcttcccacaactggatgttagcaggctctgatacgtgtgtctggataataaaaaagacaggacc

SEQ ID NO: 113466 - DNA, 685 bp, Homo sapiens
  Payload ID: 2180
  Gene Symbol: CLMN
  Gene Name: calmin (calponin-like, transmembrane)
  ENST ID: ENST00000555615
  CDS Start-End: 383-685
tgtacacaagcgtggagctctctcttggagagctggctctctccaagagagagctggcctggcctgtgagtttaactctgatctaaaacaaaccaaacgtgttacctcccgattcaaagccaagggccttgggtgccgaaagcaggaggttgccccgggcaatggcctgtattgagttcccaggagtaccttgggcaagggccatgaagtggcacgtgattgctgacccgtaggggacagagacatcgcaatgccatgagttgagagggaaaatgtgcagaagaggacctttacacgatggataaatctacatctagaaaagtgcaacccacctctagaagttaaagatttattcgtcgatatacaagatggcaaaatcctaatggctttgttagaagtcctgtctgggcggaatctgctgcacgaatacaaatcctcgtcgcatcgtatttttcggttgaacaacatagcgaaagcacttaagtttttggaagatagcaatgtaaaactggttagcattgatgcagcagaaatagcagatggcaacccttctttggttcttgggctgatatggaacataatcctcttcttccagattaaggagctcacaggcaacctcagcagaaactctccatcttccagcttgtcccctggctcagggggcacagactcagactcatccttc

SEQ ID NO: 113467 - DNA, 4242 bp, Homo sapiens
  Payload ID: 2181
  Gene Symbol: CALM1
  Gene Name: calmodulin 1 (phosphorylase kinase, delta)
  Uniprot ID: P62158
  ENST ID: ENST00000356978
  CDS Start-End: 249-698
gatacggcgcaccatatatatatcgcggggcgcagactcgcgctccggcagtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccattaacttaaagtggtgttaaatgctttgtaaagctgagatctaaatggggacaaggcaggtggaggggaggccagtgtacatgtaaatgcccacagcccagcattgggtttccctcccaaggccccagcaccaacctctgagcccaagaccttgcctgaaaacaagcagataccgattgcttcatcctatttatggacatgtaggtctagttgcattttcactggggggaggggggaaggtgaattatggtaacttttaatgatctattcaggcagtagagctcttaaggaaaaaaaaaaacccactttctctcaagcatgtatttaggggttgttctcaattgtgctgctgattacctgtcttatgtaactacttgagaccatctgcaagagacatgatttagtgtgtctgtaattcaatcttcgctgtgtgtggtagaagcagtagtcacttttgtaagccagtctcttcatgcctaaaagacactaccagtcacctttgattcgcgacttttaatttatgattatacttagcctcctcctcctttttttttttttcccaagttgacttgactttgcttttttccccccaagtagaactaatgctagcttccagcttgaaagtaaaactccagtgtggagtgaattttgtgtctaattataaacctgtaaccaaaactcagacatctggtactggtctttgcattgagattggtccctgtaaaaccccctttaaaagcatattgcatttagtacagagctcttttttgaaatgaaggctggagatgtgcatttttcacggtgttaactggttgtatcttattagcaaggagattggggttttgagtgtttgcgtgggtggtttcaatttgccagggaacagtggcaggctgctagcaaggcagtgagaagctcttggcagccaaatgggtgcattcagggctgatttatagagacccttggcttctccttctcctactccctgtctttctggcattttgtagcttgttagattttctgccagaggggtgggtcagagcagtggaggggagacatcgcccatgtgcttctgctactggtccttgggctgggtggttggtagaggagatgttgacactatgagctaagggttggcttttgtaattacctgaatctgaaaggaatgcctaaggttaccttggggtttctcttctggtgagatagggttcctggtttgagtaagttaatgtcctggatatttcttgtggcagggggtggtcaaagagcctgattgctgacccagtctcaggcctgtggtcgatgacctctcggtagtttcaaagggggctggagggggatatttgacttgttttttcgaaatgtagccttctaaccctcaagtctttagaagctgggtggactcttagtggtcctgcagcgtatcctaaaagactacctttgaaacaggattcttgtatggccaggatcctgtctgggaaccagaaaccctacaccctccccctccagggaatgctgagttccagttttgagcagaggtgaggcagaatccactgtagccttccgccctggtatttggggggatgaccagcccaggcgttgggtgttagtctgcatgagtttgtgagaggaaatagctgggtgtcctggcagtgcccttgaagttggttaggaccttcctgtaaactcttgcccctacttctaactactctataaatatatacatatatttatatataaagtgattagttgaactggcatcctgctttagcctgagacttgccataagaaactgctgagtacttggcaaaccctttcatagttttgttctccatctgtttggggtaggtgttgagcgaggcaaatggatctcgatatttcagatgggcttttgatgcactgttgccaaggaaggctttttctgattttttgacaaatgaatttttgcacactttcattggtgtctttcggcaacttacacacattgaaaatgagctattgtacatatttttatattctctttataaatgcatgtctgattgtacttgtaacaatattgtaatgaacggctgtgcagtaggcccagcgctgctgtgtctcgtcagaggaatagcttaccacgaacccctcagcatactgggaatctcttcctgaacaacgaatgtaaatttggtcaagtctactcttccgttcattcaattattttaagcatttgaattatttattgtatatcctaaatatatttctcctttggcagtgactagatttccactaatgtgtcttaatctatccctccagctggcagttactgtttttttaatcccctgaagttgtcctgtaggagacagaaattctttgctgtctgtatcccttggagtaagaaggtagtggcatgggtggagtgtgtgttctttctccaaatctattatgatgtttattaaacacttctgtagcaaagatggtggtagttcttttgttactgaagttgcccttcaccatggctatttgaaaaggagatgtacttggacgtttctgtaaatcttgagataaactgtttggagatttaaccacctctctgatgggggaccaactctatggaaattgtaaatacgttttatttataaacctggcactgtattcaataaacatttctgcagcctttca

SEQ ID NO: 113468 - DNA, 1104 bp, Homo sapiens
  Payload ID: 2181
  Gene Symbol: CALM1
  Gene Name: calmodulin 1 (phosphorylase kinase, delta)
  ENST ID: ENST00000447653
  CDS Start-End: 297-749
ggcagtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggcatccttctttaaaagagaaatccacgttagctctccttgaggtctcgagttccctcggctggaggcacaggttcagtggagaccaaataatgcaggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtatt

SEQ ID NO: 113469 - DNA, 1064 bp, Homo sapiens
  Payload ID: 2181
  Gene Symbol: CALM1
  Gene Name: calmodulin 1 (phosphorylase kinase, delta)
  ENST ID: ENST00000544280
  CDS Start-End: 333-674
cctcagccctggtgcgcgggggccgggggtggtgaccctcctggccgaggaggggcggcgtccagacgcccgctcgggggccgccttcccccccacgcctgcccccgggcacgcgccctgcccggtccctcgccccgcgccacttccagtccgcagagagatgccctccacgtttctgctttctctgcagcctctagattgccagatgcgactgtgcgcctcgctgggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaaccta

SEQ ID NO: 113470 - DNA, 438 bp, Homo sapiens
  Payload ID: 2181
  Gene Symbol: CALM1
  Gene Name: calmodulin 1 (phosphorylase kinase, delta)
  ENST ID: ENST00000553422
  CDS Start-End: 1-231
atgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctata

SEQ ID NO: 113471 - DNA, 877 bp, Homo sapiens
  Payload ID: 2181
  Gene Symbol: CALM1
  Gene Name: calmodulin 1 (phosphorylase kinase, delta)
  ENST ID: ENST00000553542
  CDS Start-End: 205-546
gccgtgccgttactcgtagtcaggcggcggcgcaggcggcggcggcggcatagcgcacagcgcgccttagcagcagcagcagcagcagcggcatcggaggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgat

SEQ ID NO: 113472 - DNA, 557 bp, Homo sapiens
  Payload ID: 2181
  Gene Symbol: CALM1
  Gene Name: calmodulin 1 (phosphorylase kinase, delta)
  ENST ID: ENST00000557020
  CDS Start-End: 263-557
agctgaaggagtgtggccaatctgcctccacctccccgcggaccccctactctcaggacctcctgcagcaccccaaactggaagtggccgctgcagacccaaggacgaggggcacgcgggagccggcagccctagtggagcggttggagatgttgaggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggtaatggcaccattgacttccccgaatttttgactatgatggctagaaaaatgaaagatacagatagtgaagaagaaatccgtgaggcattccgagtctttgacaaggatggcaatggttatatcagtgcagcagaactacgtcacgtcatgacaaacttaggagaaaaactaacagatgaagaagtagatgaaatgatcagagaagcagatattgatggagacg

SEQ ID NO: 113473 - DNA, 1420 bp, Homo sapiens
  Payload ID: 2181
  Gene Symbol: CALM1
  Gene Name: calmodulin 1 (phosphorylase kinase, delta)
  ENST ID: ENST00000553630
  CDS Start-End: 192-443
tgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtggatgctgatggatggcaatggttatatcagtgcagcagaactacgtcacgtcatgacaaacttaggagaaaaactaacagatgaagaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccatta

SEQ ID NO: 113474 - DNA, 1341 bp, Homo sapiens
  Payload ID: 2181
  Gene Symbol: CALM1
  Gene Name: calmodulin 1 (phosphorylase kinase, delta)
  ENST ID: ENST00000626705
  CDS Start-End: 200-451
agtggtgctgggagtgtcgtggacgccgtgccgttactcgtagtcaggcggcggcgcaggcggcggcggcggcatagcgcacagcgcgccttagcagcagcagcagcagcagcggcatcggaggtacccccgccgtcgcagcccccgcgctggtgcagccaccctcgctccctctgctcttcctcccttcgctcgcaccatggctgatcagctgaccgaagaacagattgctgaattcaaggaagccttctccctatttgataaagatggcgatggcaccatcacaacaaaggaacttggaactgtcatgaggtcactgggtcagaacccaacagaagctgaattgcaggatatgatcaatgaagtagatgaaatgatcagagaagcagatattgatggagacggacaagtcaactatgaagaattcgtacagatgatgactgcaaaatgaagacctactttcaactcctttttcccccctctagaagaatcaaattgaatcttttacttacctcttgcaaaaaaaagaaaaaagaaaaaagttcatttattcattctgtttctatatagcaaaactgaatgtcaaaagtaccttctgtccacacacacaaaatctgcatgtattggttggtggtcctgtcccctaaagatcaagctacacatcagttttacaatataaatacttgtactaccttaatgataaggactccttaaagttccatttgctaatgattaatacactgtttgggctggccagtttttcatgcatgcagcttgacgattgagcacagtcaggcctttgtattaaaaatgaaaaatgaaaaaacaaattcaaaacctattcaaatgggttctagttcaatttgtttagtataaattgtcatagctggtttactgaaaacaaacacatttaaaattggtttacctcaggatgacgtgcagaaaaatgggtgaaggataaaccgttgagacgtggccccactggtaggatggtcctcttgtacttcgtgtgctccgacccatggtgacgatgacacaccctggtggcatgcccgtgtatgttggtttagcgttgtctgcattgttctagagtgaaacaggtgtcaggctgtcactgttcacacaaatttttaataagaaacatttaccaagggagcatctttggactctctgtttttaaaaccttctgaaccatgacttggagccggcagagtaggctgtggctgtggacttcagcacaaccatcaacattgctgttcaaagaaattacagtttacgtccattccaagttgtaaatgctagtctttttttttttttttccaataaaaagaccattaactt

SEQ ID NO: 113475 - DNA, 1302 bp, Homo sapiens
  Payload ID: 2182
  Gene Symbol: CALM2
  Gene Name: calmodulin 2 (phosphorylase kinase, delta)
  Uniprot ID: P62158
  ENST ID: ENST00000272298
  CDS Start-End: 159-608
ctcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggta

SEQ ID NO: 113476 - DNA, 770 bp, Homo sapiens
  Payload ID: 2182
  Gene Symbol: CALM2
  Gene Name: calmodulin 2 (phosphorylase kinase, delta)
  ENST ID: ENST00000409563
  CDS Start-End: 143-733
agtccgagtggagagagcgagctgagtggttgtgtggtcgcgtctcggaaaccggtagcgcttgcagcatggctgaccaactgactgaagagcagattgcagacggagcttcactctcttgcccaggctggagtgcagtagcatgatcttggctcactgcaacctttgctgtccaacttcaagcaattctcctggctcagtctcccaagtagctgggattacaggcgtgcaccaccacacccggctagtttttgtatttttaggagagatggggtttcaccatgttggccaggctggtcttgaactgctgacgtcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaa

SEQ ID NO: 113477 - DNA, 1004 bp, Homo sapiens
  Payload ID: 2182
  Gene Symbol: CALM2
  Gene Name: calmodulin 2 (phosphorylase kinase, delta)
  ENST ID: ENST00000432899
  CDS Start-End: 58-255
agagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaat

SEQ ID NO: 113478 - DNA, 703 bp, Homo sapiens
  Payload ID: 2182
  Gene Symbol: CALM2
  Gene Name: calmodulin 2 (phosphorylase kinase, delta)
  ENST ID: ENST00000456319
  CDS Start-End: 1-564
agtccgagtggagagagcgagctgagtggttgtgtggtcgcgtctcggaaaccggtagcgcttgcagcatggttagctttgtacatagcatctcactttgcacaacaaccctgcaaggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagtagatgctgatggtaatggcacaattgacttccctgaatttctgacaatgatggcaagaaaaatgaaagacacagacagtgaagaagaaattagagaagcattccgtgtgtttgataaggatggcaatggctatattagtgctgcagaacttcgccatgtgatgacaaaccttggagagaagttaacagatgaagaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctcca

SEQ ID NO: 113479 - DNA, 1103 bp, Homo sapiens
  Payload ID: 2182
  Gene Symbol: CALM2
  Gene Name: calmodulin 2 (phosphorylase kinase, delta)
  ENST ID: ENST00000628793
  CDS Start-End: 159-410
ctcgtttgcgatgttccgttatctggatgcggcggagggatctggcggagggaggtgtttatgaggcgctgggggcggaggaggcgaattagtccgagtggagagagcgagctgagtggttgtgtggtcgcgtctcggaaaccggtagcgcttgcagcatggctgaccaactgactgaagagcagattgcagaattcaaagaagctttttcactatttgacaaagatggtgatggaactataacaacaaaggaattgggaactgtaatgagatctcttgggcagaatcccacagaagcagagttacaggacatgattaatgaagttgatgaaatgatcagggaagcagatattgatggtgatggtcaagtaaactatgaagagtttgtacaaatgatgacagcaaagtgaagaccttgtacagaatgtgttaaatttcttgtacaaaattgtttatttgccttttctttgtttgtaacttatctgtaaaaggtttctccctactgtcaaaaaaatatgcatgtatagtaattaggacttcattcctccatgttttcttcccttatcttactgtcattgtcctaaaaccttattttagaaaattgatcaagtaacatgttgcatgtggcttactctggatatatctaagcccttctgcacatctaaacttagatggagttggtcaaatgagggaacatctgggttatgccttttttaaagtagttttctttaggaactgtcagcatgttgttgttgaagtgtggagttgtaactctgcgtggactatggacagtcaacaatatgtacttaaaagttgcactattgcaaaacgggtgtattatccaggtactcgtacactatttttttgtactgctggtcctgtaccagaaacattttcttttattgttacttgctttttaaactttgtttagccacttaaaatctgcttatggcacaatttgcctcaaaatccattccaagttgtatatttgttttccaataaaaaaattacaatttacccaatggttgctctgcatctgagtcatttaactgttgaagtctaataattttgaaaataaaatatggcattggtttctgcttggt

SEQ ID NO: 113480 - DNA, 2289 bp, Homo sapiens
  Payload ID: 2183
  Gene Symbol: CALM3
  Gene Name: calmodulin 3 (phosphorylase kinase, delta)
  Uniprot ID: P62158
  ENST ID: ENST00000291295
  CDS Start-End: 200-649
gtggggcggggccgagcgaggcggggcgcgcgcggcggccgttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtcctaggaatggatgtggggatggtcgctttgtaatgtgctggttctctttttttttctttcccctctatggcccttaagactttcattttgttcagaaccatgctgggctagctaaagggtggggagagggaagatgggccccaccacgctctcaagagaacgcacctgcaataaaacagtcttgtcggccagctgcccaggggacggcagctacagcagcctctgcgtcctggtccgccagcacctcccgcttctccgtggtgacttggcgccgcttcctcacatctgtgctccgtgccctcttccctgcctcttccctcgcccacctgcctgcccccatactcccccagcggagagcatgatccgtgcccttgcttctgactttcgcctctgggacaagtaagtcaatgtgggcagttcagtcgtctgggttttttccccttttctgttcatttcatctggctccccccaccacctccccaccccaccccccaccccctgcttcccctcactgcccaggtcgatcaagtggcttttcctgggacctgcccagctttgagaatctcttctcatccaccctctggcacccagcctctgagggaaggagggatggggcatagtgggagacccagccaagagctgagggtaagggcaggtaggcgtgaggctgtggacattttcggaatgttttggttttgttttttttaaaccgggcaatattgtgttcagttcaagctgtgaagaaaaatatatatcaatgttttccaataaaatacagtgactacctgatttggctcctc

SEQ ID NO: 113481 - DNA, 702 bp, Homo sapiens
  Payload ID: 2183
  Gene Symbol: CALM3
  Gene Name: calmodulin 3 (phosphorylase kinase, delta)
  ENST ID: ENST00000391918
  CDS Start-End: 209-550
gcggcgagggaaagtagtccggcgacgggagcgagcgcgcgcgcgcccggcggcaaacccaattcctgtgcagggtggggacgagagattcgcgggcccgtaggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaa

SEQ ID NO: 113482 - DNA, 540 bp, Homo sapiens
  Payload ID: 2183
  Gene Symbol: CALM3
  Gene Name: calmodulin 3 (phosphorylase kinase, delta)
  ENST ID: ENST00000594523
  CDS Start-End: 170-511
aactgctgcagctgctgccgccgccggaggaaccttgatccccgtgctccggacaccccgggcctcgccatggctgaccagctgactgaggagcagattgcaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgt

SEQ ID NO: 113483 - DNA, 577 bp, Homo sapiens
  Payload ID: 2183
  Gene Symbol: CALM3
  Gene Name: calmodulin 3 (phosphorylase kinase, delta)
  ENST ID: ENST00000597743
  CDS Start-End: 160-411
gttgagggaccgttggggcgggaggcggcggcggcggcggcgcgcgctgcgggcagtgagtgtggaggcgcggacgcgcggcggagctggaactgctgcagctgctgccgccgccggaggaaccttgatccccgtgctccggacaccccgggcctcgccatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgct

SEQ ID NO: 113484 - DNA, 561 bp, Homo sapiens
  Payload ID: 2183
  Gene Symbol: CALM3
  Gene Name: calmodulin 3 (phosphorylase kinase, delta)
  ENST ID: ENST00000598871
  CDS Start-End: 183-524
agtgagtgtggaggcgcggacgcgcggcggagctggaactgctgcagctgctgccgccgccggaggaaccttgatccccgtgctccggacaccccgggcctcgccatgagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttga

SEQ ID NO: 113485 - DNA, 1355 bp, Homo sapiens
  Payload ID: 2183
  Gene Symbol: CALM3
  Gene Name: calmodulin 3 (phosphorylase kinase, delta)
  ENST ID: ENST00000599839
  CDS Start-End: 171-512
agcactgcagaggaggaggagggaagaacgcggctgggtggaagacaccggggcagtgggagcaggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaaggggactgacagtgggcaacactcacatcccactggctgctgttctgaaaccatctgattggctttctgaggtttggctgggtggggactgctcatttggccactctgcaaattggacttgcccgcgttcctgaagcgctctcgagctgttctgtaaatacctggtgctaacatcccatgccgctccctcctcacgatgcacccaccgccctgagggcccgtccta

SEQ ID NO: 113486 - DNA, 1203 bp, Homo sapiens
  Payload ID: 2183
  Gene Symbol: CALM3
  Gene Name: calmodulin 3 (phosphorylase kinase, delta)
  Uniprot ID: P62158
  ENST ID: ENST00000596362
  CDS Start-End: 137-586
actgcagaggaggaggagggtgaggtgcaagcttatgggaggaagagcctggggtgggtggcagcggagattagaagatactcttgaaggcttccgggacggagaaggatcagggtcgtggaggtggtgaaaagggatggctgaccagctgactgaggagcagattgcagagttcaaggaggccttctccctctttgacaaggatggagatggcactatcaccaccaaggagttggggacagtgatgagatccctgggacagaaccccactgaagcagagctgcaggatatgatcaatgaggtggatgcagatgggaacgggaccattgacttcccggagttcctgaccatgatggccagaaagatgaaggacacagacagtgaggaggagatccgagaggcgttccgtgtctttgacaaggatgggaatggctacatcagcgccgcagagctgcgtcacgtaatgacgaacctgggggagaagctgaccgatgaggaggtggatgagatgatcagggaggctgacatcgatggagatggccaggtcaattatgaagagtttgtacagatgatgactgcaaagtgaaggccccccgggcagctggcgatgcccgttctcttgatctctctcttctcgcgcgcgcactctctcttcaacactcccctgcgtaccccggttctagcaaacaccaattgattgactgagaatctgataaagcaacaaaagatttgtcccaagctgcatgattgctctttctccttcttccctgagtctctctccatgcccctcatctcttccttttgccctcgcctcttccatccatgtcttccaaggcctgatgcattcataagttgaagccctccccagatccccttggggagcctctgccctcctccagcccggatggctctcctccattttggtttgtttcctcttgtttgtcatcttattttgggtgctggggtggctgccagccctgtcccgggacctgctgggagggacaagaggccctcccccaggcagaagagcatgccctttgccgttgcatgcaaccagccctgtgattccacgtgcagatcccagcagcctgttggggcaggggtgccaagagaggcattccagaaggactgagggggcgttgaggaattgtggcgttgactggatgtggcccaggagggggtcgagggggccaactcacagaa

SEQ ID NO: 113487 - DNA, 8444 bp, Homo sapiens
  Payload ID: 2184
  Gene Symbol: CAMTA1
  Gene Name: calmodulin binding transcription activator 1
  Uniprot ID: Q9Y6Y1
  ENST ID: ENST00000303635
  CDS Start-End: 208-5229
gacgctcctcccggagagtagtgagacccctggtgcggggcgattggcggcgggagcgatgagtggcagccgcacggcccaacgggagctgtgcgtgggccgcggggcggggccagggcgggtgcgcggcggcggcggggtggctgggccggcggcggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggaaattgcagcttatttaataacatttgagaaacacgaagaatggctaaccacctcccctaagacaagaccacagaatggctcaatgatactctacaacaggaagaaagtgaaatacaggaaagatgggtattgctggaaaaagaggaaagatgggaaaacgaccagagaggaccacatgaaactcaaggtccagggagtggagtgcttgtacggctgctatgtccattcctccatcatccccaccttccaccggaggtgctactggctccttcagaaccccgacatcgtcctggtgcactacctgaacgtgccggccatcgaggactgcggcaagccttgcggccccatcctctgctccatcaacaccgacaagaaggagtgggcgaaatggacgaaagaagagctcatcgggcagctgaaacccatgttccatggcatcaagtggacctgcagcaatgggaacagcagctcaggcttctcggtggaacagctggtgcagcagatcctcgacagccaccagaccaagccccagccgcggacccacaactgcctctgcaccggcagcctgggagctggcggcagcgtgcatcacaagtgtaacagcgccaaacaccgcatcatctcgcccaaggtggagccacggacaggggggtacgggagccactcggaggtgcagcacaatgacgtgtcggagggcaagcacgagcacagccacagcaagggctccagccgtgagaagaggaacggcaaggtggccaagcccgtgctcctgcaccagagcagcaccgaggtctcctccaccaaccaggtggaagtccccgacaccacccagagctcccctgtgtccatcagcagcgggctcaacagcgacccggacatggtggacagcccggtggtcacaggtgtgtccggtatggcggtggcctctgtgatggggagcttgtcccagagcgccacggtgttcatgtcagaggtcaccaatgaggccgtgtacaccatgtcccccaccgctggccccaaccaccacctcctctcacctgacgcctctcagggcctcgtcctggccgtgagctctgatggccacaagttcgcctttcccaccacgggcagctcggagagcctgtccatgctgcccaccaacgtgtccgaagagctggtcctctccaccaccctcgacggtggccggaagattccagaaaccaccatgaactttgaccccgactgtttccttaataacccaaagcagggccagacgtacgggggtggaggcctgaaagccgagatggtcagctccaacatccggcactcgccacccggggagcggagcttcagctttaccaccgtcctcaccaaggagatcaagaccgaggacacctccttcgagcagcagatggccaaagaagcgtactcctcctccgcggcggctgtggcagccagctccctcaccctgaccgccggctccagcctcctgccgtcgggcggcggcctgagtcccagcaccaccctggagcagatggacttcagcgccatcgactccaacaaggactacacgtccagcttcagccagacgggccacagcccccacatccaccagaccccctccccgagcttcttcctgcaggacgccagcaaacccctccccgtcgagcagaacacccacagcagcctgagtgactctgggggcaccttcgtgatgcccacggtgaaaacggaggcctcgtcccaaaccagctcctgcagcggtcacgtggagacgcggatcgagtccacttcctccctccacctcatgcagttccaggccaacttccaggccatgacggcagaaggggaggtcaccatggagacctcgcaggcggcggaagggagcgaggtcctgctcaagtctggggagctgcaggcttgcagctctgagcactacctgcagccggagaccaacggggtaatccgaagcgccggcggcgtccccatcctcccgggcaacgtggtgcagggactctaccccgtggcccagcccagcctcggcaacgcctccaacatggagctcagcctggaccactttgacatctccttcagcaaccagttctccgacctgatcaacgacttcatctccgtggaggggggcagcagcaccatctatgggcaccagctggtgtcgggggacagcacggcgctctcacagtcagaggacggggcgcgggcccccttcacccaggcagagatgtgcctcccctgctgtagcccccagcagggtagcctgcagctgagcagctcggagggcggggccagcaccatggcctacatgcacgtcgccgaggtggtctcggccgcctcggcccagggcaccctaggcatgctgcagcagagcggacgggtgttcatggtgaccgactactccccagagtggtcttacccagagggaggagtgaaggtcctcatcacaggcccgtggcaagaagccagcaataactacagctgcctgtttgaccagatctcagtgcctgcatccctgattcagcctggggtgctgcgctgctactgcccagcccatgacactggtcttgtgaccctacaagttgccttcaacaaccagatcatctccaactcggtggtgtttgagtacaaagcccgggctctgcccacgctcccttcctcccagcacgactggctgtcgttggacgataaccagttcaggatgtccatcctggaacgactggagcagatggagaggaggatggccgagatgacggggtcccagcagcacaaacaggcgagcggaggcggcagcagtggaggcggcagcgggagcgggaatggagggagccaggcacagtgtgcttctgggactggggccttggggagctgctttgagagccgtgtggtcgtggtatgcgagaagatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagccccctggtggaccataggctgtacaaaaggagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaagagctactgtatttagacttaggaaaaaaggcagagtaacattacttaaaaaaaaaaggatatgtttacatttaattttggctaccaggagtttagtttattttatttaaaatttttttgccaatggtgccaagtaatgtgaatgctaatactgcttaagaaaattaagttacttttgcaaaacagataatcataagatgaatcagtatgtagcttaacaccatccactcactccaacaaagaacacttagaatgataaaaaaaaaaaaaaaaaacctgacaaaagaaatagtatgaaaagtagaaaaatgtcacgtttccatatctcctgctggaaatcagaaaatataataaaattgcacaaaaaaaaaaatgaaaaagatgcagactggtcttttagagacggcatggtatattactatttccacataatgaggagccaaagaaatctgatgtttttaacaattaaactgctaatgttaaattgagagaataaagttcgtatttgctgatgccagtttaaaattcccaggttacgtctgaggatcagttggtgtaaagctgagatgttttttcttggttctggctgccaactgtgagttaaaactcaaggcttgttgtgaagcctaaaaatattcacaaataagcttttaaactggtgtctttggaaggaaggtagatacaaaaagattgtggtaaaaactggggtcagtgctcttggtgccttttctataattgtacttgttttttaattacttcctttcactgccaacctcgaattactgtacagtatatgtctttctgcttgtgatcagctttgacaacagtgacagccccacaactagtagccacctgtacatttgtaaactgacctgactccattttgtttttaaatgtgtgggttatgttgcagctgttgcagtcccccagatacctattattttacacaatttgacctataggaggacactgagtaatttacaaacacaactgcattcataaatgggaatagaacgtgaaagccagctctttcagaatatcctctattaatactgaatttagatatctttattccatttattatggtacaaataactgatgttttaaccagagtaatgacctcagtggatttgctttaaccctcacattttttttttaatgtttcacatgttacattattagctgaatacgttagaaaatgacagatggtagagacttccatagaattaagagggttctcatggaggggataggaagtaggtttaaagcctaccagtgtaacctaccagtacaactgtgaatcctaggcgaggcaaaaatgcacttccactgaaacgaagcatttctgaccgctttttcttggttatgaatcttaatttcgaatataagatgataggtaagcgcagctttcttggataatctgaattcccaagtgccaggagtaggatttcattataaaattaatagctaatcttattctatctcctgaagatttaattgctattgttacccattcgaaatcagctgtactgtgtgaacgaaataaagacaataatacgaacccctctctggctgcacggtcgcttatggcagttccacacagtagttggcgcccaatggggggtccctgagacttgcatgtaaaactagtctagatgtcttctttttttgtaagttttatttttgtaattgtgcatgtaaagcatcattgaatcaatggatctgttgaagaactcagctgctggaaaccatgcaaaatgttttgaattgcccttaaaatatggaaaatgttttctgaatgctttatattctttctgctgtaaattaaaaatgaagaaaatttccccata

SEQ ID NO: 113488 - DNA, 546 bp, Homo sapiens
  Payload ID: 2184
  Gene Symbol: CAMTA1
  Gene Name: calmodulin binding transcription activator 1
  ENST ID: ENST00000467404
  CDS Start-End: 14-292
gaggaggaggaggatgtggcgcgcggaggggaaatggctgccgaaaacaagccggaaggcacaaggaaggacagacccagtctctgtccttatggagctaagggggagacggacattaatcaagatgccatatgaaatttcagctgggactcagtgctgtgaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataa

SEQ ID NO: 113489 - DNA, 567 bp, Homo sapiens
  Payload ID: 2184
  Gene Symbol: CAMTA1
  Gene Name: calmodulin binding transcription activator 1
  Uniprot ID: Q9Y6Y1
  ENST ID: ENST00000473578
  CDS Start-End: 52-294
ggcggcggtacgaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcattttttaatttaatttcattttttaattttggtgtacaagctgtaacatttcatctttcaaagtgtaacacgctgatttcctcaaatagagatacccctttgagtgataaatttgcaaaatgctgtcttcattttctgtattaaaattcatttcagttttaaaataaagtgtaatctgtgttttca

SEQ ID NO: 113490 - DNA, 743 bp, Homo sapiens
  Payload ID: 2184
  Gene Symbol: CAMTA1
  Gene Name: calmodulin binding transcription activator 1
  ENST ID: ENST00000482934
  CDS Start-End: 1-119
atagtagtcatgtaaaaatctttttaccgaaaaagctgcttgaatgtctgccgaaatgttcaagtttaccaaaagagaggcaccgctggaacactaatgaggtcttaaaattttggtagcagaaagcaaatgtgcaaagagcaatggaaaacaagtcagaagctgctgtctgattccagaggaactcgtattttatgttaaaaaaaatgctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaaatgaaatagaataaagtgacctactcttgcctcatccggagttattacgaaggagctccgcagcctgactgagctctggagagcagggctctgtgcacacgcctcctggtccagaggcctccgtgaccatccatgatgccactctgtcccctcagcaagctgcctttttcttcctagcacctgccccagcggtggtatgttttccagtcagttaccacctgtctcatcagaatggaagctccatgagagcagggcctttgtcttgtccccttgtatcttcagtgcataggacagtgctgacacagtgcagagtctaaataaac

SEQ ID NO: 113491 - DNA, 486 bp, Homo sapiens
  Payload ID: 2184
  Gene Symbol: CAMTA1
  Gene Name: calmodulin binding transcription activator 1
  Uniprot ID: Q9Y6Y1
  ENST ID: ENST00000557126
  CDS Start-End: 41-346
gaggcgcgcgctcggggtcccggtcgcgaggaggaggaggatgtggcgcgcggaggggaaatggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgaggctctcaccacacacttgttcatgggcgcagcaaagaagagggatccacagagctggagccatgagggctgacacattggaatgaaagctggcagaattcgtagggagagctttcccatcctgccagccccatgtctggctttaagacagttctattagtgaattaactgttctcaaaaccccaaattaatttgaaccgaatgttactaaaa

SEQ ID NO: 113492 - DNA, 3247 bp, Homo sapiens
  Payload ID: 2184
  Gene Symbol: CAMTA1
  Gene Name: calmodulin binding transcription activator 1
  ENST ID: ENST00000495233
  CDS Start-End: 1-1913
agatgatgagccgagcctgctgggcgaagtccaagcacttgatccactcaaagactttccgcggaatgaccctactccacctggccgctgcccagggctatgccaccctaatccagaccctcatcaaatggcgtacaaagcacgcggatagcattgacctggaactggaagttgaccccttgaatgtggaccacttctcctgtactcctctgatgtgggcgtgtgccctagggcacttggaagctgccgtcgtgctgtacaagtgggaccgtcgggccatctcgattcccgactctctaggaaggctgcctttgggaattgccaggtcacggggtcatgtgaaattagcagagtgtctggagcacctgcagagagatgagcaggctcagctgggacagaaccccagaatccactgtcctgcaagcgaagagcccagcacagagagctggatggcccagtggcacagcgaagccatcagctctccagaaatacccaagggagtcactgttattgcaagcaccaacccagagctgagaagacctcgttctgaaccctctaattactacagcagtgagagccacaaagattatccggctcccaaaaagcataaattgaaccctgagtacttccagacaaggcaggagaagctgcttcccactgcactgagtctggaagagccaaatatcaggaagcaaagccctagttctaagcagtctgtccccgagacactcagccccagtgaaggagtgagggacttcagccgggaactctcccctcccactccagagactgcagcatttcaagcctctggatctcagcctgtaggaaagtggaattccaaagatctttacattggtgtgtctacagtacaggtgactggaaatccgaaggggaccagtgtaggaaaggaggcagcaccttcacaggtgcgtccacgggaaccaatgagtgtcctgatgatggctaacagagaggtggtgaatacagagctggggtcctaccgtgatagtgcagaaaatgaagaatgcggccagcccatggatgacatacaggtgaacatgatgaccttggcagaacacattattgaagccacacctgaccgaatcaagcaggagaattttgtgcccatggagtcctcaggattggaaagaacagaccctgccaccattagcagtacaatgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagctgacatggatagccttgaagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaa

SEQ ID NO: 113493 - DNA, 2053 bp, Homo sapiens
  Payload ID: 2184
  Gene Symbol: CAMTA1
  Gene Name: calmodulin binding transcription activator 1
  ENST ID: ENST00000490905
  CDS Start-End: 1-719
agtcctcaggattggaaagaacagaccctgccaccattagcagtacaatgagctggctggccagttatctagcggatgctgactgccttcccagtgctgcccagatccgcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtgacattgcttttcagactgttttcatttctgtttttagcagagacatgcaacaacaacacacacgcacacacgcacacacacacacgtacacacacatacaaaatccctctgcagttttggggagatcagctgcaggattttaacaggaatgttttggtcattgcatttgcactttcatggacaacttttaatttgatcagcaagacatcttggaactcaatcttctgttggatcacgggaaatcaagacacccaggaggaattgaaagaggcttcctcttctcaggaagaagccatttccttctcatatagggctgtattcaaacatcgtgtggaactgtacaaatatttataccaaaaatatagataagaaaaggtggggctatactagcaacaaaaaaagaatgctgttcctgcacctgccggttatttccaagaagctgaatctttgggactgattctcagtggagggcttagatcatacaaaaatctttattgggtccgtgtgttctcatttccttcactgtttatttttgtttgtttgtttgtttgttttaatctctacagcacatttaatgcaacttttgaaatctgcaggtttttaatgtcttgtggaaatttgcagaggggcaggtgtgtggtaaacgggtaatgcatgggaaataatgagaagcagctcacagagtttaaactattttcttgtccccaccaccttccaagaacctgcgagggtagtaatcatcttgtcccctttttcatgttcagcactttaatttttttgccttactttcatgtgcaatgagaattacttaagaattggtaacgcatgtagccttttttagtaaccttggaagctgtagtaattctaaggaatcatgaaccttgcctggacatttgccacctaaacgatcagtgtggtgctgcgttctggccagtaaattccatgtttttggctatatctcatccaaactgagcagtttctgtgtatatatagaaggtagaaatgaaaagtgagaaaatatttgaaagggattatattaattgctaaatattttattcacaaaggtcaataacatggcaagataaaattatttgtatagttttgtctgaatgagcgagaaaaatgtggatgtactgtttgtatatattgtatatattaaaacagagatatgtgcatgaaatcaagaaaaaagaaatgaacaaaagcaaagcattagtggctatggtctgtaaaatgaaacaaaaaaactttatttcactataagagtactttattttaaatgttctttaggagaacattttgctaaagcatgactaaactgcaaaaaaaaaaaaa

SEQ ID NO: 113494 - DNA, 431 bp, Homo sapiens
  Payload ID: 2184
  Gene Symbol: CAMTA1
  Gene Name: calmodulin binding transcription activator 1
  ENST ID: ENST00000461311
  CDS Start-End: 1-222
tggctgccgaaaacaagccggaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggctctcaccacacacttgttcatgggcgcagcaaagaagagggatccacagagctggagccatgagggctgacacattggaatgaaagctggcagaattcgtagggagagctttcccatcctgccagccccatg

SEQ ID NO: 113495 - DNA, 714 bp, Homo sapiens
  Payload ID: 2184
  Gene Symbol: CAMTA1
  Gene Name: calmodulin binding transcription activator 1
  ENST ID: ENST00000476864
  CDS Start-End: 1-714
atgagctggctggccagttatctagcggatgctgactgccttcccagtgctgcccagatccgaagtgcatataacgagcctctaaccccttcttctaataccagcttgagccctgttggctctcccgtcagtgaaatcgctttcgagaaacctaaccttccctccgccgcggattggtcagaattcctgagtgcatctaccagtgagaaggtagagaatgagtttgctcagctcactctgtctgatcatgaacagagagaactctatgaggctgccaggcttgtccagacagctttccggaaatacaagggccgacccttgcgggaacagcaagaagtagctgctgctgttattcagcgttgttacagaaaatataaacagtacgcactttataaaaagatgacacaggctgccatccttatccagagcaaattccgaagttactatgaacaaaaaaaattccagcagagccgacgggctgctgtgctcatccaaaagtactaccgaagttataagaaatgtggcaaaagacggcaggctcgccggacggctgtgattgtacaacagaaactcaggagcagtttgctaaccaaaaagcaggatcaagctgctcgaaaaataatgaggtttcttcgccgctgtcgccacagagtgaaagaattgaaaaaggccaaggaacttgaagacatacagcagcatcccttagcaatgtga

SEQ ID NO: 113496 - DNA, 392 bp, Homo sapiens
  Payload ID: 2184
  Gene Symbol: CAMTA1
  Gene Name: calmodulin binding transcription activator 1
  ENST ID: ENST00000486138
  CDS Start-End: 1-133
aggaaggacagacccagtctctgtccttatggagctaagggggagacggacattaatcaagatgccatatgaaatttcagctgggactcagtgctgtgaagagcgtttcccaaagtgtattctgcggaactagcacctactgtgttctcaacaccgtgccacctatagaagatgatcatgggaacagcaatagtagtcatgtaaaaatctttttaccgaaaaagctgcttgaatgtctgccgaaatgttcaagtttaccaaaagagaggcaccgctggaacactaatgagagatcatgatgcagccgtccttttggatttctttttaataatgtgtgacccttcacctttgatcccctgacctgcattaccttggtaaccatttcatttttt

SEQ ID NO: 113497 - DNA, 4491 bp, Homo sapiens
  Payload ID: 2185
  Gene Symbol: CAMTA2
  Gene Name: calmodulin binding transcription activator 2
  Uniprot ID: O94983
  ENST ID: ENST00000348066
  CDS Start-End: 125-3733
ggggggggtcggtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacc

SEQ ID NO: 113498 - DNA, 4777 bp, Homo sapiens
  Payload ID: 2185
  Gene Symbol: CAMTA2
  Gene Name: calmodulin binding transcription activator 2
  Uniprot ID: O94983
  ENST ID: ENST00000361571
  CDS Start-End: 413-4018
ccggcacctgcactgtccctcgcccaccgcgtgcccgcggactctgctcccggcttctccagaacatccctctatgcgggcgggaccctcccacctcggaggttctcctgggaccaccactccgccggggggccgcccagagtgccaagcgtccgatccggcgccgcccaagtgcagcccaaggacccgctcccgctccgcaccctggcaggctgcctagccaggactgcgcacctgcgccctggggcggagtccttaccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca

SEQ ID NO: 113499 - DNA, 4374 bp, Homo sapiens
  Payload ID: 2185
  Gene Symbol: CAMTA2
  Gene Name: calmodulin binding transcription activator 2
  Uniprot ID: O94983
  ENST ID: ENST00000381311
  CDS Start-End: 22-3615
ggggggtcggtgtggggtagaatggccgctgccgccgtcacccgcgggaccccgggagaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca

SEQ ID NO: 113500 - DNA, 4589 bp, Homo sapiens
  Payload ID: 2185
  Gene Symbol: CAMTA2
  Gene Name: calmodulin binding transcription activator 2
  Uniprot ID: O94983
  ENST ID: ENST00000414043
  CDS Start-End: 155-3880
ccccaaccccagcttcactgcacatagccgagcccgacgggcctcctcccatctccatcctggacacctggcggagcccgtgctgagagcctccgccagctcccatctgttccccgaggagggcggggggctcaggctggagccagagcggtagatgggcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaagctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca

SEQ ID NO: 113501 - DNA, 4431 bp, Homo sapiens
  Payload ID: 2185
  Gene Symbol: CAMTA2
  Gene Name: calmodulin binding transcription activator 2
  ENST ID: ENST00000574951
  CDS Start-End: 13-498
ggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagggactgaacagaggaagagttggggagcagactagccctccccccaccccagcctgtctcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcaccagccag

SEQ ID NO: 113502 - DNA, 534 bp, Homo sapiens
  Payload ID: 2185
  Gene Symbol: CAMTA2
  Gene Name: calmodulin binding transcription activator 2
  ENST ID: ENST00000574606
  CDS Start-End: 1-534
aaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttc

SEQ ID NO: 113503 - DNA, 962 bp, Homo sapiens
  Payload ID: 2185
  Gene Symbol: CAMTA2
  Gene Name: calmodulin binding transcription activator 2
  ENST ID: ENST00000573004
  CDS Start-End: 4-495
agaatggccgctgccgccgtcacccgcgggaccccgggagaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagggactgaacagaggaagagttggggagcagactagccctccccccaccccagcctgtctcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttctt

SEQ ID NO: 113504 - DNA, 4496 bp, Homo sapiens
  Payload ID: 2185
  Gene Symbol: CAMTA2
  Gene Name: calmodulin binding transcription activator 2
  ENST ID: ENST00000572543
  CDS Start-End: 114-3737
gtgtggggtagaatggccgctgccgccgtcacccgcgggaccccgggagcacagactccccctccccccggcccctcaggccgggggtgaccttgccccctggagccctcaccatgaataccaaggacaccaccgaggttgctgaaaacagccaccacctgaagatctttctccccaagaagctgctggagtgtcttcctcgctgcccgctgctgcctccagagaggctacggtggaatacaaatgaggagattgcatcctacctgatcacctttgagaagcatgatgagtggctgtcttgtgccccaaagacaaggcctcagaatggctccatcatcctctacaatcgcaagaaggtgaaatatcggaaggatggttacctctggaagaagcggaaggatgggaagaccacccgagaggaccacatgaagctgaaggtccagggcatggagcctgtctcctggcagtgtctctatggctgctacgttcactcttccatcgtccccacattccatcggcgctgctactggctgctccagaaccctgacatcgtccttgtgcactacctgaacgtcccagccctggaggactgtggaaagggctgcagccccatcttttgttccatcagcagcgaccgtcgagagtggctgaagtggtcccgggaggagttgttgggacagctgaagcccatgtttcatggcatcaagtggagctgcgggaatggaacagaagagttctctgtagaacacctggtgcagcagattttggacacccacccaaccaagcctgctccccgaacccacgcctgtctctgcagtggggggcttggttctgggagccttacccacaaatgcagcagcacgaaacaccgcatcatctctcccaaagtggagccccgagctttaaccctgacctctatcccccacgctcaccccccagagcctcctccactgatagccccacttcccccagagctccccaaggcacacacctccccatcttcttcctcttcttcctcctcatcaggttttgcagagcccctagaaatcagacctagccctcccacttctcgagggggttcttcaagaggaggcactgctatcctcctcctgacaggactggagcagcgggctggaggcttgacgcccaccaggcacttggctccacaggctgatcctaggccttccatgagtttggcagtggttgtaggcactgagccttctgccccaccagctcctcccagtcctgcctttgaccctgatcgttttctcaacagcccccagaggggccagacatatggaggggggcagggagtaagcccagacttccccgaggcagaggccgctcataccccctgttctgccctagagcctgctgctgccctggagccccaggcagctgctcggggtcccccaccacagtcagtagcaggtgggagaagaggaaactgcttcttcatccaagatgatgacagtggggaggagctcaagggtcacggggctgccccacccataccttcaccccctccctcacccccaccctcacctgcccccttggagccgtcaagcagggtaggaagaggagaggccttgtttggaggacctgttggggccagtgaactggagcccttcagtctttcatcattcccagaccttatgggagaactcatcagtgacgaagctccaagcatccctgctccgaccccccagctgtctcctgctcttagcaccatcacagacttctccccagagtggtcctacccagagggtggggtcaaggtgctcatcacaggtccttggaccgaagccgccgagcattactcctgtgtctttgatcacatcgcagtgccagcctcacttgtccagcctggtgtcttacgctgctactgtcccgcccatgaggtagggctggtgtctttgcaggtggcagggcgggaggggcccctttctgcttctgtgctctttgagtatcgagcccgccgattcctgtctctgcctagtactcaacttgactggctgtcactggacgacaaccagttccggatgtccatactagagcgactggagcagatggagaagcggatggcagagatcgcagcagctgggcaggtgccttgccagggtcctgatgctcctccagttcaggatgaaggccaggggcctgggttcgaagcacgggtagtggtcttggtagaaagcatgatcccacgctccacctggaagggtcctgaacgtctggcccatggaagccccttccggggcatgagccttctgcacctggctgctgcccagggctatgcccgcctcatcgagaccctgagccagtggcggagtgtggagactggaagcttggacttagagcaggaggttgacccgctcaacgtggatcatttctcttgcacccctctgatgtgggcttgtgccctgggacacctggaagctgctgtgctccttttccgttggaaccgacaggcactgagcattcccgactctctgggccgtctgccattgtctgtggctcattcccggggtcatgtgcgccttgcccgctgccttgaggaactacagagacaggagccttcggtggagcccccatttgccctatcgccaccctcctccagcccagacactggtctgagcagcgtctcctcgccctcggagctgtcggatggcaccttttccgtcacgtcagcctattctagtgccccagatggcagtcccccccctgcacctctgccagcctctgagatgactatggaggacatggccccaggccagctttcctctggtgtcccagaagcccccctactcctcatggactatgaggctaccaactccaaggggcccctctcctcccttcctgccctcccaccagcttcagatgatggggctgctccagaggacgctgacagcccacaggctgtggatgtgatcccggtggacatgatctcactagccaagcagatcatcgaagccacaccggagcggattaaacgagaggacttcgtggggctgcccgaggctggagcctcaatgcgggagcggacaggggctgtggggctcagtgagaccatgtcctggctggccagctacctggagaatgtggaccatttccccagctcaacccctcccagcgaactgccctttgagcgaggtcgcctggctgtcccttcagcaccctcctgggcagagtttctctctgcatccaccagtggcaagatggaaagtgattttgccctgctgacactatcagatcacgagcagcgggaactgtatgaggctgcccgagtcatccagacggccttccgaaagtacaagggccggcggctgaaggagcagcaggaggtagcagcagctgtaatccagcgctgttaccggaagtacaagcagctgacctggattgcacttaagtttgcactctataagaagatgacccaggcggccatcctgatccagagcaagttccgaagctactatgaacagaagcgatttcagcagagccgccgagcggctgtgctcatccagcagcactaccgctcctaccgccgcaggcccggccctccccaccggacttcggccaccctgcctgcccgcaacaaaggctcctttctcaccaagaagcaggaccaggcagcccggaagatcatgagattcctgcggcgctgccgacacaggatgagggaactgaagcagaaccaggagctggaagggcttccccagccgggactggccacatgacctggccaccgcctttctcaccaccctgggggcgcctcgtgcagtcttaacagggagagggctttctggggcagggggagcccctgtcggcagctttcctgttcacctttgttggagccctctgtaggcctcctccctcctccccacgccttgctcccacacccctctcctcgtccctcctggtcgtgccccgtctcttttggtcctggctccagaaaacccgcgccccacatacctgcatcttccgctgtgacctccggagccctgcctgcccctgctccccagctcctcctgcctgcacccgactcggccccctcctgacttgccttatttatttgttcgacgcgtctctgaatgtatccgcctcggttcccaccactgccttcgctgcgcacgcccctcgtgtttcagggctgaccgtgtccccacccgactccgcatgtttgcgtctgtttcctccctctctggccctgtcttaccccatcacccgactctggccactgacctcagggccgaaggggaggtggtgtacataggaacgcgttgcggagtccgccccgtcccccgaggggaggggtcttgtacatactgtaacatacagagtatagtgaagaatctatttaaggcgccgcggggagggctgcacggccgggcttgtggttctctagcgcggcgggggcctcctgccggctccacgggcactttctacttgtgcatgggcttggtttatacgaattgccattaaacatcgctgcacca

SEQ ID NO: 113505 - DNA, 6054 bp, Homo sapiens
  Payload ID: 2186
  Gene Symbol: CAMSAP1
  Gene Name: calmodulin regulated spectrin-associated protein 1
  Uniprot ID: Q5T5Y3
  ENST ID: ENST00000312405
  CDS Start-End: 352-4326
gtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaagatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgcttta

SEQ ID NO: 113506 - DNA, 7696 bp, Homo sapiens
  Payload ID: 2186
  Gene Symbol: CAMSAP1
  Gene Name: calmodulin regulated spectrin-associated protein 1
  Uniprot ID: Q5T5Y3
  ENST ID: ENST00000389532
  CDS Start-End: 66-4874
ggcgcggcgaggggcggcggcgcctttgttgcggccgggccgccgcctcagccctttgtctgcagatggtggacgcgagcggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaaggtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattcattaagttttgggtagtgctctaatggtttgttcactttaataaagacagattttggtaaagtagaatatttttcattctgagcatgtttgtcccaaaaggtgatgcacttaagctgacagtcccttcagtggttttgttaggtcacggcttgtcctgtctggattctgcatctggaagcgctgcatgctctcagaggagcgtgccgtttcccctgtagatggatacttttgttttgttgcctatttaaaaacaattaagtggttatttgcagttatttcagaactccaagtaagtggatggctttgggttctttctgccttggtcccaatggtgttgatgcttctgtggagcgcggacattcccaggagcaggtgcgtgccagccatggctgccagacactgctgcaactgaccagctgccggaagattctggagccactaacattagttttgcacatattttcttgggagtgttacttgaatctatctcaaactgcagaaaaaatcaaaagatcaataattgggagaaaaagagacaaatttaactgttacataattttagatagacaaaaaacatgagtgagtcgtgtacataaggagggaacatggtacagaaggctagaaggaattataggtcttattcccctttcctcagtcctttgaagagaagtacagtctcttgcgattttgtatatatcgtgttcgacacagccgctctctgtcctgtaaatagggaactaaaggctgtatgatttctcaagtgctgagttacacagtcctgagtgagctttctgttaccatactttcacacgtgggctttatttctcactgtatgtttgatatgatattactgtatttattttaagaaagcactaagatgtaataaagtgatgaactaatttgctttacattgaatcgtatgtgtgaggttgctgtggctcatttcgctgaccaggcgacaccaactccttgctttataggagtttcacattgttctttaccatggccctatcgaagtcagtggaattggattctttttaatgaagagctagaaaatatctggcatagagctggaaaattgcattcccatgggacgtctgaatcaattctggattttctccatggaatgagtcagtgtgtggaacatcctgaaacttgtccttaagcgtgtagttttcactgttcgttgcgagtaagcactaatgtggcatggacattcctgatgtcccaagtccccaggccagtgttcgcctaatgattgacagaagcgtccctgcgttcttcatgcttggacacagcaacccttttaattagtcttgaaaagtttcagacacaggattaattttcgtggtggtgcttttgggcctttctggcttgggtggtggtaaagtcatgattttgcagttgataacactgacttataactctgtttatcaatgtctcctatattcaaagcccctgcagtggtatttgtgtctcgttgcaaatttctttcagcggaaagcttgcacaactttcgttgtgtctcagaattctaaccttgttatttaagacaagctgctctacccatttaggatataactttgtaaagaaagtgtaaaccaaatgattcaatgtatgatgaagtttatgtgtaaatccttggtaatgctagaattctgggagcccagaagggttgaaagagaaatgaaacttgcgtgagtcccattattttacgcatgtatgtgcagatacgttctacccacacgtgtgcgtgcacatggctgtgtgcgtgcaccaaagatggactgctttccatgtgtccttttgactttctgcacgtgtcactgcggtgcagtctcttagcagacttcaggcccaaactgtattcttcactcaggcaaaattgaaaagtggaataattctaaattacttctaggttatacttttacctccctgaaattgtagttgtcacttggagggcaaaatatttattgaaataaaattttctgttaaaaattca

SEQ ID NO: 113507 - DNA, 5730 bp, Homo sapiens
  Payload ID: 2186
  Gene Symbol: CAMSAP1
  Gene Name: calmodulin regulated spectrin-associated protein 1
  Uniprot ID: Q5T5Y3
  ENST ID: ENST00000409386
  CDS Start-End: 70-4911
gcccggcgcggcgaggggcggcggcgcctttgttgcggccgggccgccgcctcagccctttgtctgcagatggtggacgcgagcggccgcgccgccgccgagggctggaggaagatggaggccccgccggacggcgccgccgacctcgtgcccctggaccgctacgacgcggcgcgcgccaagatcgccgccaacctgcagtggatctgcgccaaggcctacggccgagataacatccctgaggacctcagagaccctttctacgttgaccagtatgagcaggagcacattaagccgcctgttatcaagcttctcctgtccagcgagctgtactgccgtgtctgcagcctcatcctgaaaggggaccaggtggccgccttacagggacaccagtctgtcatccaggccctgtcccggaaagggatctatgtgatggagagtgatgacacccccgtgacagagtccgacctcagtcgcgcacccataaaaatgagtgcccacatggcaatggtggatgccctgatgatggcctacactgtggagatgatcagcatcgagaaggtggtggccagtgtcaagcgcttctcaacgttcagtgcctcgaaagaacttccgtacgacctcgaggatgccatggtgttctggatcaacaaggtaaatcttaaaatgagagagataacagagaaagaagttaaattaaaacaacagttattggaaagtccagctcatcaaaagtctccctccaagtggtattggaagttagtgcctgtccgctatcgacgagagcacctttctgctaggcagtcaccctacttcccgttgttggaggatttgatgagagacggcagtgatggtgctgctctcttagctgtgattcactattattgcccagagcagatgaaactggatgatatatgcttaaaggaggtaacgtcgatggccgacagtctgtataatattcggcttctgagagaattctccaatgaatatcttaataaatgtttttatctcaccttggaagatatgctgtatgcgccattagtgttgaagccgaatgttatggtttttattgcggagcttttttggtggttcgagaatgtcaagccagattttgttcagcccagggatgttcaggagctgaaagacgcgaaaacagtgttacaccagaagagcagccggcctcctgtaccgatctccaacgcgaccaaacgcagtttcctaggcagccctgctgcagggaccctggctgagctgcagccccccgtgcagctgccggcggaaggctgtcacaggcactacctgcacccggaagaacctgaatacctcgggaaaggaactgctgccttcagcccatcccatcctttattgccactgagacagaaacagcagaaatccatacagggagaggacatccctgatcagcgacatcgatcgaattctttgacccgagttgatggtcagcctcgaggagcagcaatagcctggccagaaaaaaaaaccaggcctgcgtcccagccaacaccttttgctctacatcacgctgcgagttgtgaagtggatcccagctctggcgacagcatcagcttggcccgctccatcagcaaagacagtttggcatccaacattgttaatctgaccccacagaaccagccacaccccacggccacgaagagccacgggaagagcctcctgagcaatgtcagtattgaggatgaggaagaggagcttgtggctattgttagagcagacgtggttccccagcaggctgacccggagttccccagggcctcaccccgggccttaggccttacagcaaatgcccggtctccccaaggacagctggacacctcggaaagtaagcctgacagttttttcttggagcctttgatgccagcagttcttaagccagcgaaagagaagcaggtgatcaccaaggaggatgaacggggggaagggagaccgaggagcatcgtgtctaggaggcccagcgagggcccccagcctttggtacgaaggaaaatgactggcagtcgcgacttgaataggacttttaccccgattccatgctcagaattccccatgggcatcgaccccaccgagacaggaccactgtcagtggaaaccgcaggagaggtctgtggtgggcctctggcccttggcggattcgatccgttcccccagggaccatccacggatggcttcttccttcatgtaggcagggccgatgaagacaccgagggaaggttatatgttagttgttcaaaaagccccaactcccacgattcagagccgtggactctcctcaggcaggattctgactcggatgtggtggacatagaggaagccgagcacgatttcatgggtgaggcccatcctgtggttttcagcagatacattggggaggaagagtcggccaaactgcaggaggacatgaaggtgaaggaacatgaagacaaagatgacgccagcggccgctcgagcccctgcctgagcacagcctctcagatgagcagtgtctccatggcgagtgggagcgtgaagatgaccagctttgcggagaggaagctccagagactcaacagctgtgagaccaagtccagcaccagcagctcccagaagaccacgccagatgcgtctgagagctgcccagcccctctgacgacgtggaggcagaagagggagcagagtccgagccagcatggcaaggatcccgccagcctcctggcatctgagctggtacagctgcacatgcagctggaggagaagcgcagggccatcgaggcccagaagaagaagatggaggcgctgtcggcaaggcagcgcctgaagctcggcaaggctgcattcctgcatgtggtgaagaagggcaaggccgaggctgccccacccctcaggccggagcactttgcaaaggagtactctcagcacaacggggaggactgtggggacgctgtttccaaaaccgaagactttctcgtgaaggaggagcagagagaggagctccttcacgagccacaggatgtggacaaagagagcctggcctttgctcagcaacataaagcaaaagaccctgtggctctgcacgagctggagagaaataaggtgatctccgctgccctcctggaggacactgttggggaggttgtcgacgtgaatgaatgtgacctttccatcgagaagcttaacgaaaccatcagtacgctgcagcaggccatcctgaaaatctctcagcagcaagagcagcttctgatgaagtcccccacagtcccagtgccaggctctaagaataactcgcaggaccacaaagtgaaggcaccagtccacttcgtggagccactctctcccacgggcgtggctggccaccgcaaagccccccggctgggtcaaggccggaattcccgttccggaaggccggcggagctgaaggtcccaaaagacaggccacagggctcctcccgaagtaaaaccccaacgcccagtgtagagacgctcccgcacttgagacccttccctgccagcagccaccctcggacgcccacggaccctggcctggacagtgccctggagcccagtggtgacccacatgggaagtgtctcttcgacagttacaggctccatgatgaaagcaatcagcggacacttactctgtcctcttccaaagatgccaacattctttcggagcagatgagcctcaaagaagttctggatgcgagtgtgaaggaggtggggtccagctcctcagatgtctcgggaaaagagagcgtccccgtggaggagcctctgaggagcagggccagcctcattgaagtggacctctccgacctgaaggcccccgacgaggatggggagctggtaagcctcgatggctcggcggaccttgtcagcgaaggcgaccagaagccgggggtcggcttcttcttcaaggatgaacagaaagcggaagatgagctcgccaagaagcgggcggccttcctcctgaagcagcagcgcaaggccgaggaggcccgcgtgcgcaagcagcagctggaagcggaggtggagctcaagcgtgacgaagcccggcgcaaagctgaggaagaccgggtgcggaaggaggaggagaaggcgcggcgcgagctcatcaagcaggagtacctgcggaggaagcagcagcagatcctagaggagcaggggctcggcaagcccaagtcaaagccgaagaagccgcggccgaagtcggtgcaccgggaagagtcgtgcagcgactccggcaccaagtgctcctccacccctgataacttgagccggactcagtcaggctccagcctgtccttggcctctgcggcgacgacagaacccgagagcgttcattccgggggcacaccctctcagcgagtggaatcgatggaagccctgcccatactgagccgtaacccaagcaggagcacagaccgagactgggagaccgcgtcggcggcatcttccctggcctcagtggccgagtacacaggtcccaagctctttaaggagcccagtagtaaatcaaacaagccgattattcacaatgccatatcccattgctgcctggctggaaaagtgaacgaaccccacaagaattccatattggaggagctggagaagtgtgatgccaatcactacatcatactgtttcgtgatgctggctgccagttcagggcgctttactgctactatcctgatactgaggaaatctacaaactcactggcacggggccaaagaacatcaccaagaaaatgatcgacaaactgtataaatacagctcagaccgaaaacagtttaacttgatcccagccaaaaccatgtctgtcagtgtggacgcactcacaatccacaaccacctgtggcagcccaagcggcctgcagtgccaaagaaggcccagactcgtaaatgaccccggtgcagctggcgtccaaagggtgacccagactcgtaaatgatgcccttgtggctggcatccagagggtgccacggggtccttatttattgttttcatctatttgggtacgaagtgtgcaaagtcacagaccttttgcaaagaggtttctagacagcagaagaaaacccctctctcagcgctcatctcacgcagaggatgccaggcagggtgaggatgggggagtagatgccgcttttgcagtggctcgcactgctgtggccactgctgaccactgaggctcccagcggagggtgttcacagccaggtcccgggccacggagctcccttacttgaagttctccttcagcatagattagacgtgatccactttgctttcttgcttctcacctcgcccccttgcacattgcctgacaccctcatattggccagctgtaatctcgtgactatgggactgaggctcaatcttggcttggggtgtttgaatgtctatagcaaaggaattcataatgggaaatctttttcatttgagaaattgtatgatatttattggttgtgtctactgccaacatttatatccaattctaagatttctgaaaaaaaattcttatcccttgctgctcagaaaaagtttacggaaaacaccagttcactaaaagcaccgaaatctgcaaagcctgtcttccgctagaacaacgtctacaaatgtgaagatgatgacttctggcacgcggtcatgagggtggggaatggcactaggagctgatgtttgcctcatttaaagtaggcaagccgagccaactgcagccatcattc

SEQ ID NO: 113508 - DNA, 7161 bp, Homo sapiens
  Payload ID: 2187
  Gene Symbol: CAMSAP2
  Gene Name: calmodulin regulated spectrin-associated protein family, member 2
  Uniprot ID: Q08AD1
  ENST ID: ENST00000236925
  CDS Start-End: 50-4519
cgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatgagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaagtctccttccaaatggttttggaaactggttccagctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcacc

SEQ ID NO: 113509 - DNA, 7352 bp, Homo sapiens
  Payload ID: 2187
  Gene Symbol: CAMSAP2
  Gene Name: calmodulin regulated spectrin-associated protein family, member 2
  Uniprot ID: Q08AD1
  ENST ID: ENST00000358823
  CDS Start-End: 271-4707
acggggcggacctcgcgcggacggacggacggagacggcgccgccacattcctatgcccgggagcggcggcggcggcggcggcggctcccgcgggaggcggcaggcgcgcggcgcggacagctgagcttctcctccgtcggcgcccgggcggacatcgcccgggccccgatggtttgagcttgcttctccctccctcccgacccccgtggtggcgaggccacgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatgagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcctatagaaaatctttctaattgccaacaagacttttattaattaaaactggacattaagctctgttgtcatgaacaactggaatgtaaaccacagtattttggagtgcagaacattctcaattaagtgataagtccaaatgatgaaggaaatgttttaattcacaaatggagatttgtatgtgttatcaggttcacctgcttgatattagatacattaaagcactgaattttcatggatattagttggatttatcattgaaatatggttaagattacaaattatgtgttttatttgttgcttttttttaaccttttaatgtatattcttgtcttcagatggtttgctatttttctctcctgggggtttattctaagatacctttgtattttatttcatgtggagatcatgaaagtaggaaatatacctttagaagtaactcgcacctttcttatgatgttaagagaaacactagtgtttagttttacagtaaccctcatattttaatggtgttacagcatttgcaaaaattattctgctaagtatttacaactctatttattattcactcaagtattaacattctctattaaataagaggaggtgttgtaaagagctgctagtaggttcgctttaaaccacatgagcttaaccaagaatatgttatgagaagttgctgattaaatcagtgctgtttttacaccacttctggccaactcagaataatttagattgttcttttaacaaaaaaggctttctatctcttttaaagtaagtcactttataagttggcagaagtgaatgacactttgagagtagtctttcaatctgaagatgtaagacttcctgaaacaagttctcaagaagtctttacattatatttataactcatataaaaattatatttagaatttttaaacatgtacaaagggctacattttaattttaaaatagcttcacattattttacttatattgggtttttcttcattttaatccttttcaagtggaatggcttagaataagtatacacttgaaatctcctctacatgatctttgttctttaacagtgtataccagagggttagttggggaaaaacttcattctcaggaaaagacttgaatgattatgtgaccctgttatatttcagtgttgtgacaaatgtgtaaactagcgggggaagacagtattgtatcataaatgagatgcgtagtttgttttctttcatgggaagtagagataaaaatatatacatttctctaattgagttgtttagagaaagaactaatgtctcatatgatgtatttacttattttaaaaaaaagaataggaatgagatgtccctgagctgtacttttctattattataaggcctttaggcatcagtgcatctgggttatcaacattttctcaaatgctgtcaatattttactgtaatttatgttcttatatttatgtatatttgttaaaactgtaaaaaaatttcacagatttttttccaatacctgtgcaagatacatgtgtagctcaaaactatttgtgatctactgtttgcatgtaagagaccaggatatgtaactcttatattttaagtgtatacatattgtgtatataacatatggatattaaaaatggggaattgcacattttaccttttggacagtaatttctatcacagttagaaggaaatgatagtcaaatacacgtttagattaaaactagtttaaaaaattataaatgaatctaatcaaaatgtgaatagtagtcaaaaggataatttaataagcattttacgttactaaatttgttcatttcaatattaactaaatttccctcatcaaagcaatctttgtgatattacttcgctattaaataaagaaaattggatgcaagacaatggagaaactttaaaactaaacaggaccaccctttattcttaaatttgtgtgtgtccaacagttgaattgaatgtctataaggtctaaaggtagaatgtgaatattgccacagagttcattgctctcagtataagattttactttattaatgcagaaggaatatggatatatttctttaagtctgcagatttttttattatggtgcagcttttttttaattatgtttttaaaattatacagttgaaaaatatgccatttcataaagtctgaggattttcgtcaaccttactgaaacacactggtgctttcatcatcagaggtcaaattattatgataactattccattaagtttgccaaacatttgtcgtggttaccagtgcagcctgtcaaattctgctatttgacacagctttggaaagatttagttcttggtttttccgttttgtattagaatgactgttacagttttatttggctgtttaaagccaaattcagctatttaattatggtttcatggacactgttgagcaatgtacagtgtatggtgtgcttacctgtccactctagagcattgcttacaggttttttgttttttaagatgctgtgctgtaaaatactgtcatacttgctatttcctggtacagtgtagtttttcccctttcatttgaataaaagcatggcaccaaa

SEQ ID NO: 113510 - DNA, 673 bp, Homo sapiens
  Payload ID: 2187
  Gene Symbol: CAMSAP2
  Gene Name: calmodulin regulated spectrin-associated protein family, member 2
  ENST ID: ENST00000447701
  CDS Start-End: 1-400
gaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaagtggggaaggagctacatttacacagtctcatcatcatttgccttctaggtattcacgtccccaggctcattcttcagcctcaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagt

SEQ ID NO: 113511 - DNA, 4498 bp, Homo sapiens
  Payload ID: 2187
  Gene Symbol: CAMSAP2
  Gene Name: calmodulin regulated spectrin-associated protein family, member 2
  Uniprot ID: Q08AD1
  ENST ID: ENST00000413307
  CDS Start-End: 50-4438
cgccatgtgaaggttagggccgggacatcccgaggagccgcggtgaaagatgggggatgctgcagaccccagggagatgagaaagacgttcattgttccagccatcaagccttttgaccactatgatttctccagggccaaaatcgcctgcaatctggcctggctggtggccaaagcctttgggacagaaaatgtgccagaggaacttcaagaaccattttacacagatcagtatgaccaggaacacatcaaaccacctgttgttaatttgcttctatcggctgaactatactgtcgtgctgggagtctcattctcaagagtgatgctgcaaaaccccttttgggccatgatgctgtaatccaggctttagcacagaaaggtctttatgtcactgaccaggaaaaattggtaactgaacgagatctccacaagaaacccatacagatgagtgcacatttggccatgatcgataccctcatgatggcttatactgtagaaatggtcagtatagaaaaagtaattgcgtgtgctcagcagtattcagctttttttcaagccacagatctgccctatgatattgaggacgctgtcatgtactggataaataaggtaaatgaacatttgaaagacataatggaacaagaacaaaaactgaaagaacatcacacagttgaagctccaggaggtcaaaaggctcgttatcggaaagagcaaacattgcttaagcaactgccttgcattccattggtagaaaatttgttgaaggatgggacagatggctgtgcattagctgcccttattcatttttactgtcctgatgttgtcagattagaggatatttgtttgaaagaaactatgtctttggctgatagcctgtataatctgcagctgattcaagaattttgccaagaatacttgaaccagtgttgccatttcactctggaagatatgctctatgctgcttcatccataaagagtaattatttggtgttcatggcggaactgttctggtggtttgaagtggtgaagccgtcttttgtacagcctcgtgttgttcgtccacaaggagctgaacctgtaaaagatatgccttcaattcctgtcttgaatgctgccaaaagaaatgtcttagatagtagttctgacttcccttcaaggtattcacgtccccaggctcattcttcagcctcaggaggaattagaaggtcttcatctatgtcttatgttgatggcttcatagggacatggcccaaagagaaaagatcatcagtgcatggcgtatcatttgatatttcttttgataaagaagatagtgtacagagatccactccaaaccgaggaatcactcgttctattagtaatgaaggacttactctgaacaacagtcatgtatctaaacacattaggaaaaatttgtccttcaagccaataaatggagaagaggaagcagagagcattgaagaagaacttaatatagattctcacagtgacctcaaatcttgtgtgccccttaacacaaatgaactaaattctaatgagaatattcattacaagcttccaaatggagctttacaaaatagaatacttcttgacgagtttggcaatcagatcgagacaccaagcattgaagaagcattacaaataattcatgatactgaaaaatctcctcatacacctcagccagaccaaattgctaatggcttctttcttcatagtcaagaaatgagtatcttaaattcaaatatcaagttaaatcaatctagtcctgataatgtaactgatacgaaaggtgccttgagtcccataactgacaatactgaagtagacactggaattcacgttccttcagaagatattcctgaaactatggacgaagattcttcgttgagagattatactgtaagcttggactctgacatggatgatgcatctaaatttcttcaggattatgatattcgaactggcaacaccagggaagctttgagtccttgtccaagtactgtaagtaccaagtctcagccaggcagcagtgcttcttctagttctggagttaaaatgaccagctttgctgaacaaaaattcaggaaactgaatcataccgatggaaaaagtagtggaagcagttctcaaaaaactacaccagaaggctctgaacttaatattcctcatgtggttgcttgggcacaaattccagaagaaacagggcttccacagggacgggacactacccagctgttggcctctgaaatggtgcatcttaggatgaaactagaagaaaagaggcgtgctatagaagcccagaaaaagaaaatggaagctgcttttaccaaacagagacagaaaatgggaaggacagcattccttactgtagtgaaaaagaaaggggatgggatatctcctctacgagaggaagcggcgggtgcagaagatgagaaagtatatactgatcgagcaaaagaaaaggaatcacaaaaaactgatggacaaaggagcaagtcactggcagatataaaagagagcatggagaatcctcaagccaaatggctaaagtctccaactacacctattgatcctgagaagcagtggaacctggcaagcccctcagaagaaactttaaatgaaggagagattttagaatataccaaatccattgaaaagttaaattcatccctgcattttctacaacaagaaatgcaacgcttgtcacttcagcaggagatgttaatgcagatgagagagcaacaatcttgggtgatttcacctccacaaccctctccacagaaacagattcgagattttaagccttctaagcaggcaggcctgtcatcagccattgcaccattctcctcagactcccctcgtcctactcacccatctccacagtcttctaacaggaaaagtgcatctttttctgttaaaagtcaaaggactcctaggccaaatgagttaaaaataacacctttgaatcgaaccttgacacctcctcggtctgtggatagccttcctcggttaaggaggttttcaccaagtcaagttcctattcaaactaggtcatttgtatgttttggggatgatggagaacctcagttaaaggaatccaaacctaaagaggaagttaaaaaggaggaattggaatccaaagggactttggaacagcgtggacataatccagaagaaaaggaaatcaaaccttttgagtcaacagtctctgaagtcctatcactgcctgtcacagagactgtatgtctgacaccaaatgaggaccaattgaatcaacccacagaaccccctcctaaacccgttttcccacccactgctccaaaaaatgttaatctgattgaagtttccctctcagatttgaaaccccctgaaaaggctgatgtacctgttgaaaaatatgatggagaaagtgataaagaacaatttgatgatgaccagaaagtatgctgtggattcttttttaaggatgatcaaaaagcagaaaatgatatggcaatgaaacgggcagctttgttggagaaaagattaagaagggaaaaggaaactcagctccggaaacaacagttggaagcagaaatggagcataagaaggaggaaacaaggcgtaaaactgaggaagaacgtcagaagaaagaagatgagagagcacgcagagaatttattaggcaagaatatatgaggcggaaacaactgaaactaatggaagatatggatacagtaattaaaccccgtcctcaagtagtaaaacaaaaaaaacagcgaccaaaatctattcacagagatcatattgaatcccccaaaacaccaataaagggtcctccagtctctagcctttctttggcatcgctgaacacgggtgataacgagagtgtacattcaggcaagaggacgccaagatcagagtctgtagaaggcttcttatctccaagtcgttgtggcagtcgaaatggagaaaaagactgggagaatgcatcaacaacttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggaaatggagaaatcagatgccaacaacttcttaatcttgttccgggattcaggatgccagttcagatctttatacacttattgcccagaaactgaagaaatcaataaactgactgggataggccctaaatctatcactaaaaaaatgattgaaggactttacaaatataattctgacaggaaacagtttagccacatacccgctaaaactttatctgccagtgttgatgcaattaccattcatagccatttatggcagaccaaaagaccagtaacacccaaaaaacttttacccactaaggcatagaagttgggaaatacttgcttcagaacattcatggtaaatttgcacttcatctttcctgcc

SEQ ID NO: 113512 - DNA, 451 bp, Homo sapiens
  Payload ID: 2187
  Gene Symbol: CAMSAP2
  Gene Name: calmodulin regulated spectrin-associated protein family, member 2
  ENST ID: ENST00000475326
  CDS Start-End: 1-169
ttcttcagtggcttctggaacagaatatacaggaccaaagctctacaaagaacccagtgcaaaatccaataagcacataatacaaaatgctttagctcattgctgtttggctggaaaagtaaatgaaggtcagaagaaaaaaatactggaggtaagcatgtttgcatgaaaattaaatttggcaaactgtagaagtcttttatccattcaagagaatgtactctcatgggcctagactttcaacagcatgtaaaaagatctgtagctagatgttttaattatcagatttagtttattttcacattaggttctggaagcctgcagattttattaaagactagcaataggctttaagatttgtcattgaaataatgttataaaatgtgactaagaaacgtaacataattatataaactttattcagcaaaataaagggtttttattcgtgttg

SEQ ID NO: 113513 - DNA, 3889 bp, Homo sapiens
  Payload ID: 2188
  Gene Symbol: CAMSAP3
  Gene Name: calmodulin regulated spectrin-associated protein family, member 3
  Uniprot ID: Q9P1Y5
  ENST ID: ENST00000160298
  CDS Start-End: 102-3851
gcggcggtagcagcagcgggcccggctggggcgcgagcgcggcgcagcccagcccagcccagtccgagcgcggacccggcgcccgcagccccggcgccgccatggtggaggcggcgccccccgggcccgggccgctgcggaggacctttctagtgcccgagatcaagtcgctggaccagtacgatttctcgcgggccaaggcggcggccagcctggcgtgggtgctgcgggccgcgttcgggggcgcagagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaagctgcttttctgggtggacacgaccgtccggcggctgcaggagaagaccgagcaggaagcggcccagcgagcctctccagcagcccctgcagacggggcggccccggcgcagccctcgatccgataccgcaaggaccgtgtggtggcgcgacgtgccccctgcttcccgacggtgaccagcctccaggacctggccagtggggccgcgctggccgccaccatccactgctattgtccccagctgcttcgacttgaggaggtgtgcttgaaggaccccatgtctgtggcggacagcctgtacaacctccagctcgtgcaggatttctgtgcctctcgccttcctcgtggctgccccctgtcccttgaggacttgctgtacgtcccaccgccactcaaggtcaacttggtggtgatgctggccgagttgttcatgtgttttgaggtgctcaagcccgactttgtgcaagtgaaggacttgcccgatggtcacgctgcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgct

SEQ ID NO: 113514 - DNA, 4179 bp, Homo sapiens
  Payload ID: 2188
  Gene Symbol: CAMSAP3
  Gene Name: calmodulin regulated spectrin-associated protein family, member 3
  Uniprot ID: Q9P1Y5
  ENST ID: ENST00000446248
  CDS Start-End: 102-3932
gcggcggtagcagcagcgggcccggctggggcgcgagcgcggcgcagcccagcccagcccagtccgagcgcggacccggcgcccgcagccccggcgccgccatggtggaggcggcgccccccgggcccgggccgctgcggaggacctttctagtgcccgagatcaagtcgctggaccagtacgatttctcgcgggccaaggcggcggccagcctggcgtgggtgctgcgggccgcgttcgggggcgcagagcacgtgcccccggagctgtgggagcccttctataccgaccagtacgcgcaggagcatgtgaagcccccggtgacacggctgctgctctcagccgagctctactgcagagcctggcgccaggcactgccacagcttgaaacaccccccaacccctctgcactgctggccctgctggcgcggaggggcacagtgcctgctttgcccgagcgcccggtgcgcgaggccgacctgaggcaccagcccattctcatgggagcccacctagctgtcattgatgccctcatggctgcctttgccttcgagtggacaaagaccctgccaggtcccttggccctgaccagcttggagcacaagctgcttttctgggtggacacgaccgtccggcggctgcaggagaagaccgagcaggaagcggcccagcgagcctctccagcagcccctgcagacggggcggccccggcgcagccctcgtgccctacgcgctggtactggaagctggttcctcacgcaattgccttctgtttgaaggagtcggggagcaaaccccccatgatccgataccgcaaggaccgtgtggtggcgcgacgtgccccctgcttcccgacggtgaccagcctccaggacctggccagtggggccgcgctggccgccaccatccactgctattgtccccagctgcttcgacttgaggaggtgtgcttgaaggaccccatgtctgtggcggacagcctgtacaacctccagctcgtgcaggatttctgtgcctctcgccttcctcgtggctgccccctgtcccttgaggacttgctgtacgtcccaccgccactcaaggtcaacttggtggtgatgctggccgagttgttcatgtgttttgaggtgctcaagcccgactttgtgcaagtgaaggacttgcccgatggtcacgctgcctccccccggggcactgaggcctccccacctcagaacaacagcggcagtagttctcctgtcttcaccttccgccacccgcttctgtcatctggtggcccccagtccccactccgaggatccacaggctccctgaagtcttccccgtccatgtcccatatggaggccctgggcaaggcctggaaccggcagctcagccgtcccctctcccaggctgtgtcattcagcaccccctttggcctggacagcgacgtggatgtcgtcatgggagaccctgtgctcctccgctctgtgagctcggacagcctgggccccccgcgtcccgcgccggccaggacccccacccagccacccccggagcctggtgacctgcccaccatcgaggaagctctgcagatcatccacagtgccgagccccggctcctcccagatggggcggccgacggcagcttctacctccactcccctgaggggccctccaagccatccctggcctccccctacctgcccgaggggacctccaaaccactgtccgacaggcccaccaaagcaccagtgtacatgccacaccccgagaccccctcgaaaccatctccctgtctggtgggggaggcatcgaaaccgccagccccatccgaggggtccccgaaggcggtggcttcgtccccagcagccaccaactccgaggtgaaaatgaccagctttgcagaacgcaagaaacagctggtgaaggcagaggctgaggccggagcggggtcccccacgtccactccggccccgccggaggccctgagctcggagatgagtgagctcagcgcccggctggaggagaaacgcagagccatcgaggctcagaagcgacggattgaggccatattcgccaagcaccgccagcggctgggcaaaagcgccttcctgcaggtgcagccgcgggaagcctctggggaggcggaagcagaggcggaggaggccgattccggtccagtccctggtggggagcggcccgcaggcgagggccagggtgagccaacctcacggcccaaggcagtgaccttctcgccagacctgggcccggtgccccacgaggggctgggggaatacaatcgagcggtcagcaagctgagtgccgccttgagctcgctgcagcgggacatgcagaggctcacggaccagcagcagcggctcctggccccgcccgaggcccccggatccgccccaccacctgctgcgtgggtcatccctggccccacgacggggcccaaagctgcatcccccagccccgcccggcgagtcccggccacccggcgcagccctgggcccgggcccagccagtcaccccgcagcccgaaacacacgcggccagcggagctgcggctggcacccttgaccagggtgcttacgccaccccacgacgtagacagcctcccccacctgcgcaagttctcgccgagccaggtgcccgtgcagacgcgctcttccatcctcctggcggaggagacgccccccgaggagccagccgcccggccgggcctcatcgagatcccgctgggcagcctggcagatcccgccgccgaggacgagggagacgggagccccgctggtgctgaggattccttggaggaggaggcgtcttcggagggggagccccgggtggggctggggttcttctacaaggatgaagacaagcctgaggacgagatggcccaaaagcgggccagcctgctggagcggcagcagcggcgagcagaggaggcgcggcggcgcaagcagtggcaggaggtggagaaggaacagcggagggaggaggccgcgaggctggcccaagaggaggccccgggcccagccccgcttgtgtccgcagtcccgatggcgactccagcccctgctgcccgggctccagccgaggaggaggtgggcccccggaagggggacttcacgcggcaggagtacgagcgccgggcccagctgaagctgatggacgacctcgataaggtgctgcggccccgggctgcggggtccgggggtccaggtcggggcgggcggagggccacccggcctcgctcgggttgctgtgacgactcagccctggcacgaagcccagcccgcggcctgctgggctctcggctgagcaaaatctattcccagtccaccctgtcactgtccactgtggccaacgaggcccacaataacctcggggtgaagaggcccacgtctcgggctccctccccgtcaggtctcatgtccccaagccgcctgcctggaagccgcgaacgggactgggaaaatggcagcaatgcctcctccccagcgtcagtgcccgagtacacaggtccacggctgtacaaagaacccagcgccaagtccaacaagttcatcatccacaatgccctatcacactgctgcctggcgggcaaggtgaacgaaccgcagaagaatcgcattctggaggaaattgagaaaagcaaggccaaccacttcctgatcctctttcgcgactcgagctgccagttccgggcgctctacacgctgtcgggggagacagaggagctgtcgcggctggcagggtatgggccccggaccgtcacgcccgccatggtggaaggcatctacaagtacaactcggaccgcaagcgcttcacccagatccccgccaagaccatgtccatgagcgtcgatgccttcaccatccagggacacctctggcagggcaagaaacccaccactcccaagaagggcggcggcacccccaaatagccccacccgggcggtccacgggccgggccctgtgtgctgcggccgccatcccctggaggacagtcagtcggtattcctgggtcctgtctgtccccaaccgtgtctgggtggggctggagtctccaccctctgactttgagtccagtcctgctgtgggggctgagctgggaggttcagggactcagggctcagctcagtccccttgtctgtcctcccccacttcttgaataaaataatttaaagagaa

SEQ ID NO: 113515 - DNA, 2763 bp, Homo sapiens
  Payload ID: 2189
  Gene Symbol: CALML3
  Gene Name: calmodulin-like 3
  Uniprot ID: P27482
  ENST ID: ENST00000315238
  CDS Start-End: 1078-1527
gagctcctggggcaatgtggaccagagaatgatagtgggacttcctggctgagcccttcaaggtctcctttgtctctcctccttgtcccctccctcacaggcctgcagccccactgatcatcttccagcccttggccctgccatggccactccggcctagacagctgcttctcagcaggaggtctgtccttgaccaggctgaaaggtgacctcggggtcctgtccatcaccaccttgtatgtccatcagcatttatcaataatccctagtcaccttgtttgcattcctcgatcagttgacctgcaaactagctgtcttgctagttaacctcacgaggactgggggtggcttgccggtcccactgtgttcccagcttccagagtgacactgcacctagtaggcactcaaatatctgtgaaagggtggatgagtgaatgggttggaggaaacccctccctattcatgtccattctgaagataagaaaactcgctgcttctacctgaagggaaaaccttcctcctccaaaaaccctcctgttctatatgaggctttagaaaccaaaggcaaggacgtttctttcatctgcctttcatcctgcaaaaagccctccactcaagggaagaaagggcactggagtttattgagtgggagacaggcggcaggtgggagacggggagggaggagagaaagggaaattcaggaggaaggagtccagcgtggattgctccaaagctcacccaccacgccctgactgcaggtgtgattcggggcccccgtggctctgctgggtccaggtgcaagcaggcacagaggtgctggcgtcagctcgattcgcaggccctggactcctgtctaaacaggacaggcccgggcaaccgcagggcaggggcgtctgccaatgatgggggaggactctgctgcttcttaagctccagcgtctcaagccagggcgagacagcccgccggccgcccggatctccacctgccaccccagagctgggacagcagccgggctgcggcactgggagggagaccccacagtggcctcttctgccacccacgcccccacccctggcatggccgaccagctgactgaggagcaggtcacagaattcaaggaggccttctccctgtttgacaaggatggggacggctgcatcaccacccgcgagctgggcacggtcatgcggtccctgggccagaaccccacggaggccgagctgcgggacatgatgagtgagatcgaccgggacggcaacggcaccgtggacttccccgagttcctgggcatgatggccaggaagatgaaggacacggacaacgaggaggagatccgcgaggccttccgcgtgttcgacaaggacggcaacggcttcgtcagcgccgccgagctgcgacacgtcatgacccggctgggggagaagctgagtgacgaggaggtggacgagatgatccgggccgcggacacggacggagacggacaggtgaactacgaggagtttgtccgtgtgctggtgtccaagtgaggccggcgcccaccatgctcctgggcgcccacgcggcccacagggcaagaacccggggcctcccgcctcctcccccatccccctgcctcccctgggcactgtggcttcctcctgcgcctggttgattcagcccacctctctgcatcccgcttcccgcgtctcttctctgcactcctgccgaccttcccacctgctcgtctgaatgacacggaacgctcccactgcaggcaaaccgtgacgccctccccactcgggagaagcagagctgaccttaggaccgagcaccagggcaggttgcgctgactctgcggccctccaggacggacaccgggtgaccccttagggcacccaggcaagatccctaagaggcacccaatgcccaggccaggggggctgcagccctcagcccccgccaggattcccgcaggctcctggactggaagctccctccgcggtcggattctggagggtgggaggcatcttggcctgcagtaagcggtgctgacggggactctggccacagaggtcaggcctcctgaaaacagcactgccttccgcgctgccccagcttgccccattccttgtccgccaacccaccgtgattcatcttctgaagctgggagtgaaactgggtcagctgtaacctgttcctattcatctggaaggagggaggcttggatgagcaggggatgagagctgcagggaaataaatgagatattcgtccttatttcatttcctttttttttttggtttccatggaaatgatccttgttaaattcagggttgaaacgaggcaggaatctccatttttgtgctttttgaaaatgcaatgaattcctatacgggggagcgggaaaggtgcctcagagagagacaagtctggatgagggaaatattgaatattctcaatcaaatggatacgctggcagcaaagagtggttaaaagtccatcaggacttgaaagacctgagtccattacgttgagaagggacctgctgattgctttgattccccctggcaagtgctccctggttgtgaagtgccaggcactagagatggtgaggggttggggggcagttgggcacacacagtgtaagagcaattcagagccgttagtcctgcactagccctgcaagctgctggcaacacctagagaaggtcgaaggggccctgccagagatcccttcaattctaaagggaggtatgttttgcgggatgggcactagacggagctc

SEQ ID NO: 113516 - DNA, 4155 bp, Homo sapiens
  Payload ID: 2190
  Gene Symbol: CALML4
  Gene Name: calmodulin-like 4
  Uniprot ID: Q96GE6
  ENST ID: ENST00000395465
  CDS Start-End: 704-883
agaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggatgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtcaaagcttttctatgtctatatttatcactgaatagtcccagtatggttttaaagcaagttttatgaatctcatttgcctaacaggaatctgaaatataacttgccaaaaacacacagttggtgtggaatggtcattagaacctggggctcctcttcacggactccctgctcattaagggattcagtggtccagagtctaagatcctattaagtgtttgattcaaacctctacccgaggaagggctgttaccttactcctggtcctggtttcaagctcattcctgaaattccagctggtttctctagcacctagtgttgtttacaagaaggccacggtgctcttagcattcaaactgcagatactaaacagatgctgtgatttattaaagagttagccatatttcaacaagaaagggaaatgatggctatattcattacttacctcaaagcatgctgcaagaaaattagttagttacttgtcatgctttgaaatctctggatgaaaggtgctttggaagcacaaaccattatcacttgtctcatagggattgtccccttgaacatccagcagtgttattttacagaagacaaattaactgaaggcttttcttttattacatctaaagagctctacataaacaggtaacattcaataggtaaacaatttttttccaatgcatgtaataaatattttcacttggtacttttatacaaactgacattgtctactatacatttttaaaagccattttactggtttggcatgcggtatggaaattctaagagagaaagttttaaggcaatgaatcacagatttaagttcatggaatttatggtaactttatctgtttatgtacattttcccctttgttaaacaattaacagcagcacactctgggaccaccagctattttccctctctttctgaaatctaagctttgtatttaattaaaaaacagaattcaacatctattgataaaacaaaattcttactaaaataatttcaaatgtgctttaaaaagtcctgaagatcttgaaagttttatgtgtttaaaattgaaattgtctaaaaaaatgctctttccacattaatttagttaggatatattttcactccatttcagacacttgactcaaaggaaaatctgccaaagaatccgatttttcagagcttacgtgaatctttcctcagtaaagatacagaattgtgatcatgtctaaataattagtaaagcaattttaatgctcaaaatagtcaaccaag

SEQ ID NO: 113517 - DNA, 2520 bp, Homo sapiens
  Payload ID: 2190
  Gene Symbol: CALML4
  Gene Name: calmodulin-like 4
  Uniprot ID: Q96GE6
  ENST ID: ENST00000448060
  CDS Start-End: 113-562
gagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggccaagtttctttcccaagaccaaattaatgacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtc

SEQ ID NO: 113518 - DNA, 987 bp, Homo sapiens
  Payload ID: 2190
  Gene Symbol: CALML4
  Gene Name: calmodulin-like 4
  Uniprot ID: Q96GE6
  ENST ID: ENST00000467889
  CDS Start-End: 186-776
agggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatggccaagtttctttcccaagaccaaattaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttatt

SEQ ID NO: 113519 - DNA, 3651 bp, Homo sapiens
  Payload ID: 2190
  Gene Symbol: CALML4
  Gene Name: calmodulin-like 4
  ENST ID: ENST00000478113
  CDS Start-End: 1-90
gaacgcggttctgggagcagcaagcccacgggtagcagccgaggccccagaatgacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtcaaagcttttctatgtctatatttatcactgaatagtcccagtatggttttaaagcaagttttatgaatctcatttgcctaacaggaatctgaaatataacttgccaaaaacacacagttggtgtggaatggtcattagaacctggggctcctcttcacggactccctgctcattaagggattcagtggtccagagtctaagatcctattaagtgtttgattcaaacctctacccgaggaagggctgttaccttactcctggtcctggtttcaagctcattcctgaaattccagctggtttctctagcacctagtgttgtttacaagaaggccacggtgctcttagcattcaaactgcagatactaaacagatgctgtgatttattaaagagttagccatatttcaacaagaaagggaaatgatggctatattcattacttacctcaaagcatgctgcaagaaaattagttagttacttgtcatgctttgaaatctctggatgaaaggtgctttggaagcacaaaccattatcacttgtctcatagggattgtccccttgaacatccagcagtgttattttacagaagacaaattaactgaaggcttttcttttattacatctaaagagctctacataaacaggtaacattcaataggtaaacaatttttttccaatgcatgtaataaatattttcacttggtacttttatacaaactgacattgtctactatacatttttaaaagccattttactggtttggcatgcggtatggaaattctaagagagaaagttttaaggcaatgaatcacagatttaagttcatggaatttatggtaactttatctgtttatgtacattttcccctttgttaaacaattaacagcagcacactctgggaccaccagctattttccctctctttctgaaatctaagctttgtatttaattaaaaaacagaattcaacatctattgataaaacaaaattcttactaaaataatttcaaatgtgctttaaaaagtcctgaagatcttgaaagttttatgtgtttaaaattgaaattgtctaaaaaaatgctctttccacattaatttagttaggatatattttcactccatttcagacacttgactcaaaggaaaatctgccaaagaatccgatttttcagagcttacgtgaatctttcctcagtaaagatacagaattgtgatcatgtctaaataattagtaaagcaattttaatgctcaaaatagtcaaccaagtatggcatggttctggttcagattttttttttttaagatgtatccaataacactcacgaagtaattaaaagccactttaaccctgcta

SEQ ID NO: 113520 - DNA, 1445 bp, Homo sapiens
  Payload ID: 2190
  Gene Symbol: CALML4
  Gene Name: calmodulin-like 4
  ENST ID: ENST00000395463
  CDS Start-End: 674-856
ccggcactaagaggcctcactccaagcccccgaggagcctgtggtggggctggagacccggctcaggcccctccaccacccttaaagtcctcagaaggtgggaactgaactggcacaggatgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttatta

SEQ ID NO: 113521 - DNA, 4603 bp, Homo sapiens
  Payload ID: 2190
  Gene Symbol: CALML4
  Gene Name: calmodulin-like 4
  Uniprot ID: Q96GE6
  ENST ID: ENST00000540479
  CDS Start-End: 932-1294
ggggctgagggtggagagaggaagggaaggaagaaaaggggagccttcctggccagggtaaccggcactaagaggcctcactccaagcccccgaggagcctgtggtggggctggagacccggctcaggcccctccaccacccttaaagtcctcagaaggtgggaactgaactggcacaggatgggaaccggctgtgcgctggccacttgattttgccagctgccctgtaattcagctggtgaggaaactgaggcacagactgaggtagaatgattcgccagtcactcagcaagtcagcagacggggaggactgaatcccagcctgagagcaccgaagcttgtatccctgcaataccgagccccaagcctgcgagccccggtgcccatctctgagttaggccgtcttggaagggttcccttcctcctacaagatggtgtgtgaggagccttcaatacgacccggggtgtaaagtgtccaactctagtaggggcctgatggcatccccgccgagtcccaggagagagagagaagaccccttcctggagtccagggctcccgggaagaaacactggcatttgtccctttgcttcggcttctggaggcagagactctgagcccagggagagccttctgcagccccatttcctcaaaaatccaacctgcccaggtggcgggtcatgagctgtgctcaggaagctggaatctgaccctggtggcgtcgggcccagtctccatggcagccgagcatttattacccgggcctccacccagcttggcagactttagacttgaggctggaggaaagggaactgaacgcggttctgggagcagcaagcccacgggtagcagccgaggccccagaatgagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaagtggatgatctcttcagggaagcagatatcgaacccaatggcaaagtgaagtatgatgaatttatccacaagatcacccttcctggacgggactattgaaggaggagaatgggagagcctcccctgggcctgaaaacttggagcaattaattttttttaaaaagtgttcttttcacttgggagagatggcaaacacagtggcaagacaacattacccaactatagaagagaggctaactagcaacaataatagatgatttcagccatggtatgagtagatctttaataaaagatttgtattgattttattaactaccgtgagtccggccctttcaagcatggaaggagcctgcggtttggagtctggcctgggttccagtcctggctctgctgcttcccactgtgactttgggcaaatcatttcactcctcaaagcccccccacacaagctggattcccacttcttacctcatggagcctgttgaggaaggattgagctgatgacttaagggcaatctaccaagagacttattctgtatttgggggctagaaccatcttccatatttccaagattttccaagatgaagccagtgctagctgagaagcagcaatgaacagaaagctgtaacacttatgacaacaattcttgcagtgccagaggcccatttacaaattctcatttccatctcaacagatatagtgacatagctcaggctattcattcataaacacagagtgtagagtgaaaacactagagtgaaaacacatgctacaatgaggcagcatcagctgagagcaggaagagcgatctactttacaccccacaccaaaggaaaccagatgtgagctgctaaattgactggccttgcagagctcaagaagggggcttccaatgctgtgagaattccgagctgttccctgggctctgttaacaggcagagaggttccgggatggtctgctcaagtggcccacactggtcattgccttaagccacctccccaggacttacggagagaaataaggggatgtaaccagcaatggccagggtacaacagccctggaaaacagtagtaggagcactaggctttctgggagtccatccagctggagtggctttgagtgagttacacagctagaaggtgccaggttggtgctgccagagattcagaggtgccatacacttgtcaaatctggatcattcgtagtgccagcacagtcctaaaagggctggagtaccacaccaacacaggtaggggtgcagggcttcaagtacaaagatttgcatccatgtatgtatcaaaagtgggttctctgggctgtggctttgtctagtagtaccacagtggctaaagtagaagaaaaccaaatcaaatgggatgtgtcttttgggaggatgtacaagacacaaatctttcactaggcaccgggcacagggaaaactgcagggaacaagagttgtagtgttagtgcaactgtctcaacgatgctgtgtggcttcagacccaaacaaggccctgaggaaggagactctcatttccccaagcataactgcaaggagaggaggaattcctaggagccaaagagttttgtggggtgagggtaaataaatggcccaaatgccaactaggtgaagttgtgaccatctggctgggaagcccaggtccacacagtgtaggagcagatgttttgtggggtctgaggtttacgagatttggctgccttaagaatacaaaaacagaaatgcagaatttctggggctgctcctaggaccagaacaagtgaagggtcctggtgcttaaacttcattaccttcatggtaaatccaccagagggccggttagatgctggccccgccgagagaactgctgtcactttcaggcaaagctcaaaggtcctaggcccacagttcttttgagctccagtcatggacattaggaagtaaatcctgcacagccaacctggaataccaaagattagatgggagatagataccaatgatttagatggcacaggaagagcaagttctggatataataaatgagggtactttccgtcaaagcttttctatgtctatatttatcactgaatagtcccagtatggttttaaagcaagttttatgaatctcatttgcctaacaggaatctgaaatataacttgccaaaaacacacagttggtgtggaatggtcattagaacctggggctcctcttcacggactccctgctcattaagggattcagtggtccagagtctaagatcctattaagtgtttgattcaaacctctacccgaggaagggctgttaccttactcctggtcctggtttcaagctcattcctgaaattccagctggtttctctagcacctagtgttgtttacaagaaggccacggtgctcttagcattcaaactgcagatactaaacagatgctgtgatttattaaagagttagccatatttcaacaagaaagggaaatgatggctatattcattacttacctcaaagcatgctgcaagaaaattagttagttacttgtcatgctttgaaatctctggatgaaaggtgctttggaagcacaaaccattatcacttgtctcatagggattgtccccttgaacatccagcagtgttattttacagaagacaaattaactgaaggcttttcttttattacatctaaagagctctacataaacaggtaacattcaataggtaaacaatttttttccaatgcatgtaataaatattttcacttggtacttttatacaaactgacattgtctactatacatttttaaaagccattttactggtttggcatgcggtatggaaattctaagagagaaagttttaaggcaatgaatcacagatttaagttcatggaatttatggtaactttatctgtttatgtacattttcccctttgttaaacaattaacagcagcacactctgggaccaccagctattttccctctctttctgaaatctaagctttgtatttaattaaaaaacagaattcaacatctattgataaaacaaaattcttactaaaataatttcaaatgtgctttaaaaagtcctgaagatcttgaaagttttatgtgtttaaaattgaaattgtctaaaaaaatgctctttccacattaatttagttaggatatattttcactccatttcagacacttgactcaaaggaaaatctgccaaagaatccgatttttcagagcttacgtgaatctttcctcagtaaagatacagaattgtgatcatgtctaaataattagtaaagcaattttaatgctcaaaatagtcaaccaagtatggcatggttctggttcagattttttttttttaagatgtatccaataacactcacgaagtaattaaaagccactttaaccctgct

SEQ ID NO: 113522 - DNA, 611 bp, Homo sapiens
  Payload ID: 2190
  Gene Symbol: CALML4
  Gene Name: calmodulin-like 4
  ENST ID: ENST00000354678
  CDS Start-End: 347-611
gaatttcagacaaacaacaaatacttttccaatagaagtatatgtcctatgcaaaatttggggcatacaataaaagtatattcagtgtttatctgaattcggtttaacttggcagtcctgtattttcatttgctgtatctagcacccttgggaggggagagagggatggagggagtaggcaaaaggaaggggaaaagagggagaagagactaaggatggggagggcggcatgggcggagagtgaccagacgctgctgaccctccctctgggccgtgtgcagagtacaaggaatgcttctccctgtatgacaagcagcagagggggaagataaaagccaccgacctcatggtggccatgaggtgcctgggggccagcccgacgccaggggaggtgcagcggcacctgcagacccacgggatagacggaaatggagagctggatttctccacttttctgaccattatgcacatgcaaataaaacaagaagacccaaagaaagaaattcttctagccatgttgatggtggacaaggagaagaaaggttacgtcatggcgtccgacctgcggtcaaaactcacgagtctgggggagaagctcacccacaaggaag

SEQ ID NO: 113523 - DNA, 859 bp, Homo sapiens
  Payload ID: 2191
  Gene Symbol: CALML5
  Gene Name: calmodulin-like 5
  Uniprot ID: Q9NZT1
  ENST ID: ENST00000380332
  CDS Start-End: 118-558
agacgctgcccggatccctgcggctgcctgcactctggaccacgagctctgagagcagcaggttgagggccggtgggcagcagctcggaggctccgcgaggtgcaggagacgcaggcatggccggtgagctgactcctgaggaggaggcccagtacaaaaaggctttctccgcggttgacacggatggaaacggcaccatcaatgcccaggagctgggcgcggcgctgaaggccacgggcaagaacctctcggaggcccagctaaggaaactcatctccgaggttgacagcgacggcgacggcgaaatcagcttccaggagttcctgacggcggcgaagaaggccagggccggcctggaggacctgcaggtcgccttccgcgccttcgaccaggatggcgacggccacatcaccgtggacgagctcaggcgggccatggcggggctggggcagccgctgccgcaggaggagctggacgccatgatccgcgaggccgacgtggaccaggacgggcgggtgaactacgaggagttcgcgaggatgctcgcccaggagtgaggctccccgcctgtgtccccctggctgcgctctgagccttcagggccaccgcccgctgctgcttttgtgctgggactctccggggaaacctggtcggtggatgggaaactgcctccccctgggaggaaggctttgcgctccggggcctggatgcggcgccctcgggccgcctgcgagcccctctctgcctccagaccttgggcagaaggaggcctccttgggcctggtccccctttgccctgcagtggaatgagggcccctcagccccgcattgatctaaataaaggactgccgagttcca

SEQ ID NO: 113524 - DNA, 1101 bp, Homo sapiens
  Payload ID: 2192
  Gene Symbol: CALML6
  Gene Name: calmodulin-like 6
  Uniprot ID: Q8TD86
  ENST ID: ENST00000307786
  CDS Start-End: 455-1000
ggtaattagacccagacagggagggctcagtgcgggtctgaggagggaacacacgtgtgcaggcgtgtgctccacggtggcatgttgatacggaccagcctgggcaccaggccccctcgggagccagctttgctgttctgagtggaagggagatcaggtttccctgagaaaccccaaaatagcccccaactgtgcctggcttccagcgggcagcccagcccccaggccctgttttgctccctttcccccttcacccccagcccatgtcctgctgtctcctccctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactgcagccctggtgtcaccaccctgcagaatcctgtcagacaaccaccgacatgacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacaacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtacgtgctaatgaacgcaggggagcccctcaacgaggtggaggcggagcagatgatgaaggaggccgacaaggatggggacaggaccatcgactatgaggagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagccc

SEQ ID NO: 113525 - DNA, 769 bp, Homo sapiens
  Payload ID: 2192
  Gene Symbol: CALML6
  Gene Name: calmodulin-like 6
  ENST ID: ENST00000378604
  CDS Start-End: 174-668
cctgaatggtggaccctcagcccctcctgtacaagatggtcaagcggtgcctcatgcatttgttcattcgacctgtcctgagagtttgtgacatgctggcacggggccaatgttgagtccaccaggatgggagggtggccaggctctgagccactgagcaccagctggccaggatgggtcttcaacaagaaatctcactgacagagcgcctgtcggctgagcagatcaaggagtacaagggagtctttgagatgttcgacgaagagggcaacggggaggtgaagacgggggagctggagtggctcatgagcctgctgggtatcaaccccaccaagagtgagctggcctcaatggccaaggatgtggacagagacaacaaagggttcttcaactgcgatggtttcctggcactaatgggagtttaccatgagaaggcccagaaccaggagagcgagctgagggcggcattccgtgtctttgacaaagagggcaagggctacattgactggaacacactcaagtacgtgctaatgaacgcaggggagcccctcaacgaggtggaggcggagcagatgatgaaggaggccgacaaggatggggacaggaccatcgactatgaggagtttgtggccatgatgacgggggagtccttcaagctgatccagtaggtgcagctgccgcagccgggggaggcctgcccgggaaggctgctgcccctgccccctggcccccactcccccggctccgtgtaaaataaatgttccagccc

SEQ ID NO: 113526 - DNA, 1495 bp, Homo sapiens
  Payload ID: 2193
  Gene Symbol: CAMKMT
  Gene Name: calmodulin-lysine N-methyltransferase
  Uniprot ID: Q7Z624
  ENST ID: ENST00000378494
  CDS Start-End: 45-1016
gagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgcatctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatagaagattaagcttctcaaagacgaagaaacgtatcaagtgcatagggaatatttttacaaaaacggaaatctgtaaggggtataatcgcctgcctgcgccctttgcagcatttcacgtgtgggctatggactccacctgtcctcacccacgttattccccagctgccctctccagctccctccccgcctctttttacactctgcttgttgctcgtcctgccctaaacctttgtttgtctttaaatgtgtataagctgcctgtctgtgacttgaatttgactggtgaacaaactaaatatttttccctgtaattgagacagaatttcttttgatgatacccatccctccttcattttttttttttttttggtctttgttctgttttggtggtggtagtttttaatcagtaaacccagcaaatatcatgattctttcctggttagaaaaataaataaagtgtatctttttatctccctccaa

SEQ ID NO: 113527 - DNA, 652 bp, Homo sapiens
  Payload ID: 2193
  Gene Symbol: CAMKMT
  Gene Name: calmodulin-lysine N-methyltransferase
  ENST ID: ENST00000407131
  CDS Start-End: 53-463
caggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttatgatgtctcactttattgcccatgttggtcttgatctcctggactcaagcaatccttctgcctcagcctcccaaagtgtgattagtagcatgagccactgctcccagctgtgtatgcatttcttgcggacagttgtatagttgggtcttggattttgagcccatctgacaagtttttctttttaattgtactgtttaattgaactgaatttaattattgatat

SEQ ID NO: 113528 - DNA, 1114 bp, Homo sapiens
  Payload ID: 2193
  Gene Symbol: CAMKMT
  Gene Name: calmodulin-lysine N-methyltransferase
  Uniprot ID: Q7Z624
  ENST ID: ENST00000403853
  CDS Start-End: 45-443
gagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttgggaagcaaccaggggaaaatgaagatatcaccatcagtagtaactcttccttttttgtttaaatggtaaatatgcctggggagatgggacttataagaaaagatgttttggccaaggcatcctacctctgcttgtcttcatgatcttcattacaatcatagcagaaatcctcatgctaaatgtttttcttttccttcttttctgggagatcattaatcagctatcctattttcctattttacgatttctccttctccagcccaattatgttttctacaaagctagtgtctgggatactaactcttaactcattcaagcaagcttctcggctatatcattacaataaattctatttaaaatacttagtgaagtacagtattcataagccagttattgcattaggtgtagctgcagtgacactgattagcattcatcataaagatagttgaatatgatttatttatatttgtatgtaagtatatatattttgaatatgtactatgctcatatgattcaaagttcaaaatggcctcaagagtataaactgtgaaaagtctcctttccatctgtccttcatcaacccagtttccctctctggaaataaccacaatgactaatttcttttgtattcttccagagttattttctgcatacaaataaaaacatgtatggttgcatatatttctgtatact

SEQ ID NO: 113529 - DNA, 665 bp, Homo sapiens
  Payload ID: 2193
  Gene Symbol: CAMKMT
  Gene Name: calmodulin-lysine N-methyltransferase
  ENST ID: ENST00000402247
  CDS Start-End: 59-478
tcctggcaggggacgagctgcggcggtggcacctccgggtgtggaaggctccagtgagatggagtcgcgagtcgcggacgctgggaccggcgagaccgcgcgagcagcgggcgggagtccggcagttggctgcaccactcgggggcccgtagtctcggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcagtaagtaagcctatgtcctacatgatgtctgtaaactccactccctcttagacttac

SEQ ID NO: 113530 - DNA, 843 bp, Homo sapiens
  Payload ID: 2193
  Gene Symbol: CAMKMT
  Gene Name: calmodulin-lysine N-methyltransferase
  ENST ID: ENST00000454433
  CDS Start-End: 1-281
cggcgcccctgggagccgcccggtggaagctcctgcggcaggttctgaagcaaaaacacctggatgattgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttaaaggtttaagactttggaatgatactcacctgcatttgacttctggctctgaaattcatcttgagcaatttgtatcatctctatgaacctcaactgttttcatctcttagggctggctgtgttataaagaaagtaacttttcattgcttgaatttcttcgaatgttgtgggaagaaattaagaggaatctcgtacagaatgaatcacgtctgcgtattgatttattgctgtgtgatatacgacccaaccttctttttatatatttatatttactatggtggaaaacaaaccattttgaaagtgcttacctttaactaggaatagccagtatcttcgagaaagcgtatttttgaaacatacttatttgagttaaaattgtgaaatgcatttaaaaattgaaattgaaagtagaactactggagaagttttaaatatttattggaacagaaagagcaatctccacaagtgtttattaagttcctattatgtgctgtcctgcattttcaattctcaaatgatttatcaactttgaagtacaaagtagtaaaacattctttctacac

SEQ ID NO: 113531 - DNA, 401 bp, Homo sapiens
  Payload ID: 2193
  Gene Symbol: CAMKMT
  Gene Name: calmodulin-lysine N-methyltransferase
  ENST ID: ENST00000428929
  CDS Start-End: 1-214
ttgcctgcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttaaaggtttaagactttggaatgatactcacctgcatttgacttctggctctgaaattcatcttgagcaatttgtatcatctctatgaacctcaactgttttcatctcttagggctggctgtgttataaagaaagtacgtacatactgcatggctgagagttgatatgcaataaaagttattaattatta

SEQ ID NO: 113532 - DNA, 526 bp, Homo sapiens
  Payload ID: 2193
  Gene Symbol: CAMKMT
  Gene Name: calmodulin-lysine N-methyltransferase
  ENST ID: ENST00000428993
  CDS Start-End: 1-250
gcgacatgtatctgtaagaagatttgaatcatttaatctgttttcagtaacagaaggcaaagaaagggaaactgaagaggaggttggtgcatgggtccaatatacaagcatcttctgtcctgaatacagtatctccttaaggcataatagtggatccttgaatgttgaagatgtccttaccagctttgacaatacaggaaatgtttacacagggtctcactctgttgcccaggctggagtgcagtggtgatcataactcagtgcagcctcaaactcctgaactgctcatatatttaagaaacacttcgtggcagaagattatgatactcttgcttatttattggcttaaggattaaggatccccaaagtctcagacttcatcagttaccaagatctattgaccatctatccactcttttctgaaccaaaggcatactctaaaagcttgcagtgactggatgagtcaaattctgtcacttcctctttacaagttgttttgtaatgattaaaccagtgatacattgta

SEQ ID NO: 113533 - DNA, 594 bp, Homo sapiens
  Payload ID: 2193
  Gene Symbol: CAMKMT
  Gene Name: calmodulin-lysine N-methyltransferase
  ENST ID: ENST00000613618
  CDS Start-End: 1-594
atctggccatctgaagaggttttggcttactactgcctcaagcacaataatatattcagggcccttgctgtgtgtgagctagggggtggcatgacatgcttggctgggctcatggttgctatttctgcagatgtcaaagaagttctgttaactgatgggaatgaaaaggccatcagaaatgtgcaagacatcatcacaaggaatcagaaggctggtgtgtttaagacccagaaaatatcaagctgcgttttacgatgggataatgagacagatgtctctcaactggaaggacattttgacattgttatgtgtgctgactgcctgtttctggaccagtacagagccagccttgttgatgcaataaagagattactccagcccagggggaaagcgatggtatttgccccacgccgagggaatactttaaaccagttttgcaatctagctgaaaaagctggtttctgtatccaaagacatgaaaattatgatgaacacatttcaaacttccactccaagttgaaaaaggaaaacccggacatatatgaagaaaaccttcattacccgcttctgcttattttgaccaaacatggatag

SEQ ID NO: 113534 - DNA, 9243 bp, Homo sapiens
  Payload ID: 2194
  Gene Symbol: CALN1
  Gene Name: calneuron 1
  Uniprot ID: Q9BXU9
  ENST ID: ENST00000329008
  CDS Start-End: 300-959
gacaaggacagggaggcacgcgcccagatcgcgctccgagtcgacgagggggctcgtgcaggtcccggcgcgcgcgtggggagcggcccgggggcgccgagggagccggcggcagcgaggatgccggcacggggacgcggctgcctgctgggggtgtgagcgagaggctgagcgctgcccgctcggcgcatccattccgcaccgccccctccctgcgggcctcggaggaagccccccgcgctgtgcggaggcgcctcggctgccgggctgcggagccccggcccagcaagagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 113535 - DNA, 9459 bp, Homo sapiens
  Payload ID: 2194
  Gene Symbol: CALN1
  Gene Name: calneuron 1
  Uniprot ID: Q9BXU9
  ENST ID: ENST00000395275
  CDS Start-End: 390-1175
aagagaataaaagctggctccccgagcccgctggggaagctcgctggggtgctatccgcttgagtttgtgtttttttctttcctgcttcttaataaagcttactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagagtctcagtgccttcgctgacgttcctttgatgagcttctaactctctctgagaacatcgccctggacccccgatgcggctgccagagcaacccggagaggggaagcccgagaatgagaaaaagggggacggaggagccctcggagggggagaggagccgccgaggagccaggcccccgacttccccacctgggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 113536 - DNA, 9189 bp, Homo sapiens
  Payload ID: 2194
  Gene Symbol: CALN1
  Gene Name: calneuron 1
  Uniprot ID: Q9BXU9
  ENST ID: ENST00000395276
  CDS Start-End: 246-905
tcccccgagatcagcaggagcttactgcttactctgggtccgcgccacctttaaagctcacggccgcggtctgcgtcttcgttcttgaagtcagcaagaccgcaagcccaccgggaggagcagacgactccggacgcgccatctttaagagctgtaacactcaccgcgaggtccgtggttttattcttaaagtcggcgagaccaacaacccagcagaaggaataaattccgcacacagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttga

SEQ ID NO: 113537 - DNA, 8571 bp, Homo sapiens
  Payload ID: 2194
  Gene Symbol: CALN1
  Gene Name: calneuron 1
  ENST ID: ENST00000405452
  CDS Start-End: 1-288
cagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtagcagcctcccgccagccacactgtgttgcagctcaccgcgcatgtgcatgccgtgcgggcagactcttcctccacacagcagacacggacctatggactatggatggatgcggacgatggaaccgttcagtaaagaacccaaggttgagtgcaactggggttgcacttcagcttcatctccttggcagggacactaaagggctgtcttcagtgctttaatggttttgttttctaatgcaataaatcgccaggatttccaaattattgcttcaaccatcagtcataactctagagaaaaacttcatcttcatctcggaattccagcagccatccaggtataatggtgagagagcaagagagaggcatgaacacacagtcacctccactccccattctttcaacccaagggtcaacaggagactctctgctgaggtcaaccctcagttccaagaggctgacttcagggttgccacagaagagggggctttccatcccaccctggcttccttcctccacccagtggagacccccccaaggcatgaggggaaagccattaagtggggtgcagccctggcggtcttcagctgcacccctcaccgcttccgttcttactgccttttctagaggactgccattggtagagctggggtgctctcagtttccgtcggcacttggctttctgttcctagagcccatcccgcaccagcattttggaacctgcagagagcctttctcccagctttgccgcctgtgctgccattagagaaaaaaagaagcataatcgtgggcatctctataacatagacagatatatatatttggcttcttcgtgtgtgatgtcattcttccctaatcgcttacacctaatataagcttgtcctccctcccacactcatccctgcttctttggggcaggggtgaggcaggttgaggggggaggggactgggactggcggtgaggttttgatacccacacccagccatctggagtcatggagacccaccacgtctctatgccggatgacctttgtaagttaaggtccttgtgcatcttacctttcccttaccttggagtttgctttgttagtcttccccagctaaaaagagaaatgcaatccaaaatggaaagatggagagatcaaacgactgtattttcacataagatcttctggccttcagattctgcaactgactcattttcaggaggttgggggaaaagatgtttatgagtttagccaacagaacaggtaatttactcctgcctgcagaatacttttcgttggggaagagaactgaatccaaggatctgttttcaacaccattccaagtctgtaatttcctgacttttcctagatgtcagccactactatgaattcaagcttgtgtagtcagattagccagtaatctctagatgtaatagttccctttgtacttttccaagctcaggtctttattttgtaatggaattaccttgctcctacttcttttgattacatcctaaaactacatgcttccccccttccagtagcgagccaccagaagctttcttgtctctatgcagtgggtaggattttttggtgcgttgtgtgttcctgatctccctccctgtcttcctgctcagctttctccctactgccttttcagacttggagcacccaaggtctccaatgaaagttttctcattcacctctgcaagtgctactggcaacagcctgagggcagctgtagaaactttccctctgtgggagactatgaatattcctgatgagcacaagtaaaactaaggcttcagccataatatggaggagggagcagatgtaagctcccaagagcctgggggatcacaggtccctctgcaaaacttcctggagttcagcccagcaaggccagaccaaggaggcagcaacctgcctttcccccttacctgccctgctgcctgcacactgcatgcctgccccttctgctgctcctgttggctgactcaccactgtccccttaggattggaattctcaactagaaccggtccaaatgcagaatattaatacatcgaacaacttcatccttaatctctgccctgggcagtttgccctctcccatctggacttagatgggagggcatagcagatcttgaagggatatactttcctgtttttccctgacccccgaaccacccaaccacatccataggggtgcaggaccctaagtagactgggtagaaaccccagggatgattcttcaaagccccctcctccatgagaggggactgaaatgctgcagctgaggctggtcttcagggcagaaaatgagtacttctttgaaggtggcttttctgcgagttcttctgcctcctgctggagaacagagacccttcaagaggtgagggttagatttcattggcagagagattagccactgtgcaggagtagggaggaaaaggagttctggagaggcgccgccatcctgttttctggaaaggctgcaggattcctttcctaacggtgaccttcttcttgctcccagtgacctggaagcaagcccaccctccccaggggaaaatctaggagaatgcattcctctgcagactgctagagagagatggcaagaaggaagacacagaattctttctgacagcctaggagttatcttcccactgtggtaaccccccatgtggcacccagggactgaaggacacagtgcgtggagacggccctgagctagcggcattccttagacttcaggagctcagagtttgtcccggtgacttgcaccctggctgctttgcttggacagtttgtcttgggtatagggaagccttccttgtcaggcagccaactcccagccctgttcacacaaattttatgctagggccccatgccagtcagtgtccccatcatggtggctatgaagctcacggctgaagattccagaaggtcctggtctcccatgcccaagggatgccatgtagccccagctggaagtgacttccgcaggaattgagagggaatagctcacccctcattctgtcctccggacttaggaaccagtgaccttggctgcccaactgtgtggaggctgagtgattgacaaacacaggttggctcattcttgctgcaagagcaggtaccccccgccgcccccctggaaagcacaagtgatgagcaagaaggcattttccttgggagagaaggggaaatggaccctgacccccttgatccccaaagaagctgcgccccacctttccagatacccacaaagcccccagacagaatctagcatcgggactattagcaatggcttccagaatgtgcttgggtcccacgtgactgatctgacaaaaaaaaaagagggatattaccatggcaacccttgcattccaccctgagtttgccaaggcacacaaaaatagggaacattttcttaaagaacactccaattcagcctgagtgcaacctgactctctgcatctgtatcctgctgggagaggcaattacccttaaagaatctgggtggtatctctgcctttttgtctggcatttgaacttgtccttctatttactcaggagagcaggagctacctgtaagccctggtatctccccatccctactcccagccccttctcccagggtccagagccaggaccccttaatctaggtaaattgacagaaatatcatcttggaaggcaaacaagatattaagcctccaatctttaaaagtatcggtttgcctgttgagcacactcctgcaagccaaacacgtgaactttggtgaactgaggtttaggtgtggtcttaggcaaacccagtggtttcagaaatgtctgggtgttttatttgcagagaacaagatgtgtcttatgagtcttctttctcaatacctgccctgtctcaaatctcacttgacaaatggtctacgatcttgcagttatccaaaagagcctatgaaaaatggacagctgcttttgacaataatgcccctcccaacttcccattcatagaatcataaagcgatatgtttcagaactgagagagaaaagtttaccttttattccaaatgcctcgtactcggtttaagtccagactcaggtcataaatcaaagacagttttgcacgttgctcttcacctaaatctagcagtttccctgaggccctatgagggcatggacagaaaatgaaggatgcaaccacccaggacagctccctggtttgggctggcctggccacgtgtggtcacatgtcctgggatctgtgtttactgtgtccttgctctccttccttgcagaagctgctaagctctgctcctcctaactgcaggtctcaaaccctattgggtcattttgccacactatttctccaaaggcccatagtcattacattttttaccatttcaccaagataacagggggggtctggaattcccctgctaggaagggccccttttcctatatcaccgtgatggtacagatgaactgagatgaaacttttagacttcagcacgtcacacatcctggttgtataaccaggaggtctgcagagctgcaacccctgaagaacatctgtcttaaaagacctcaaatcagaacattctcattggcctcttcagtgatccccatggagctaagagtccgtaacctaaaggccttaccatagccatcttccctccacacctgattgctcaactgccccagaaggggagaatctatctgaaatagaaaagaagcattaaggaccaggtgcggtggctcacacctataatcccagcactttgggaggccaaggcaggtggatcacttaagatcaggagttcaagaccagcctggccaacgtggtgaaaccccatctctactaaaaaaaaaaaatacaaaaattagccaagcatggtgtcgggcacctgtaatcctagctactctggaggctgaggagggagaatcacttgaaccctggaggcggaggctgcagtgagctgagatcgcgccactgcactccagcctgggcaacagagcaaaacttcatctcaaaaaataattttaaaaaagaaacattattcaccagctaagacttttcaatttaaattatttaaagtgacagcaacatagaggagaatttgggctgcctcttaccgacccagtctccatgataatttgagtgtcacaactgttcagcttcacttcatacttgctttgactaagtcactcgggattgtcctcaattttttggccctgccataaataggtgtatgttagtccgttttgcattgctataaaggaataccttaacactgggtaatttataaagaaaagaggtttatttggctcgcagttctgcaggctgtttgagcaaggtatcaacatctgcttggcttctggtgagacctcagaaagctttgacccatggtggaaggtgaagggggagcaggcacgtcacacagcaagaacaggagcaagagagaggagaagaggtgccagtctccttttcttaacaacccgcaattgcatgaactaataaagtaagaattcactcattactacagggagggcaccgagtcattcatgaggaatctgtccctatgacccaaatatctcccagcaggccccacctccagcactggagatcaacatgaaatttggggggaacaaatatccagcctctatgattggtttggagcaatgagatcaattacaccaacaagccaagcatttctcttagtatcctatggtcattgctaatgcatatggtcattttgacagctgtggtttctccttcatattcatttgggactcttcatagggtctcgagagacatgacaatactgttcaaaacgtctccaaggcaaaattaattttattccgttgactggaaatatatcacaaagaatgaggtttttccagtcccacccacaagacagtcctctgaaagtggaaaagcttgcccggccacctgcccctaccctgaccttggggtagttcatcagttgagcacaacccccatgccgggcatagactcacccatctcttttcctcaggtgtgatgggttggctttcaaactagtgtttctcgcactgttagaagttattgtccaagtggaaaggatgcagaggctggaattttccagtgggatagaagagcaggctaattaggaaggaatattccagggaatgcaaggtgcaactgcgatattgctccatccctggacctgagggagacaaagaaagttcttaaagggctgcagatgctgtcctctgaaggtcttctctggatcgctggcctactttggaaacatgcaggccattgagtgccatggggctgcccatcagtctgatccacacgaaaggctctgtgcatttcaagagcaggctggtagctcgccattcctgggaggatgctgacatctgtcaagcccagaatgcctctctcagggctctcagacctgttaaactgaggccaggagagcagaagaaagaactcaaagtgtggacggtactaccagctggagaaagcccaggagccaggactcttccacccactatctaggttatgttgagtgacattcctccctggcttcaggtttctctaaagccagaggaaaagtaaaccagacaagccctcccatctattttgtctgaaacaagatggagtgaatgctccctactgagagggtctggatttcacccatgaattgcactaggaactgggagctcctttttgaacacaagtcccaagaggcagttgtgataaagtctctcttttggtgtccgctgtctgtaaatgaaacaatgcaaattggtgtatgttaaatgtgtcacagcttgcaggcaagaggttttgtttattctctaaggacttgctgactcgagggagcatcaaagatgagctttctgtctgtcttggcaagtgtgaaaataaagggagtcagtcacctccccaaaggtcatgtgaatcagaattcaggagaaagttggaggaaacaatggcagattccaagaagagatgcttgtttctccatttgagaaagccttactgaaagctactgaataaagagcacaatttccagttatttctttctttgcttttttttttttctggccactataacagcacttccagtatatgttgatagtagcttgtaattattcctaataccccagaaagaagagagtcgtgatctttggtgattgtgaggaattagattaacagtcgcgggggaccggctacctgcgacagccctttaaatggctaatgagggatgctgagtgctgagcggtgcctgcttttgatgtggcccacccatgaccagggagagagggcaggaagagagcagctgcaggatccacaagtctctaacccttctgccccaggcaacataaaaccctagattcttgttctttttccctcttcctaaagtagactgacgtcccagtaattgtttttctaacaagccctgttgttctccctgggaaagacctagattggccaagaaaggatcctgtcagctcctggtggagagttgcacaagccagtggctctcaactctctccaaggaaaattaaagcatattttctctttcttagctcaaaatcagctttcaggggtccttattggggtctgattttcttccccagttctgaatccaggaagaagctttttctccaaggaccaaccaaaaacaatgactttggagaaaaattagactcagaaagtctgtccaggcattgggttggtgaactgtcaactgttggatggggaggaggggtcgctgtgatcgtagcggtcattagacttgggacgtgagttgtctctcaaagcacagtagtaaatgactgtattttgtatattgcccccaatatgttgggtgtaaatagaagcacagctggggattgatcatggccaggacgattggagcttggcagctctcatatccagaataagccactaagacggaactcatcaatcaccatcttcccatttacctcattagcatcccattttctctcattcagtattagttgatgatttctgctattaagtgatgagaaagtcagcagactagtcaaaaaagaatctttatataaaatgtacatattaatataaattaacttagcatgcaacttaccgatcaaatgaagtatatattattaatatgttatcttagtgtataaaggaaaactgccatatttaccagatgttttctttaaccgaacttgtctgtaaatatataatctgtataaaaagagtctaatttaccattatttatgcaatagaaaaaataaaagtttttttttcttttg

SEQ ID NO: 113538 - DNA, 777 bp, Homo sapiens
  Payload ID: 2194
  Gene Symbol: CALN1
  Gene Name: calneuron 1
  Uniprot ID: Q9BXU9
  ENST ID: ENST00000431984
  CDS Start-End: 118-777
ggtccatcattctgaggagctgcagtgccctgctccttcctgatggcttagagattctccttaactcccagccatggatcttggagaatttcccccgagatcagcaggagggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcagtttgacatgcaaaggataactctggaagagttgaagcacattctctatcatgccttccgagaccacctaacgatgaaggacattgagaacatcattatcaatgaggaagagagcctgaatgagacctcggggaactgccaaacagagtttgaaggagtgcattcccagaagcagaacagacagacctgcgtccggaagagcctcatatgcgcctttgctatggccttcatcatcagtgtcatgctgattgcagccaaccagatactccggagcggcatggagtag

SEQ ID NO: 113539 - DNA, 550 bp, Homo sapiens
  Payload ID: 2194
  Gene Symbol: CALN1
  Gene Name: calneuron 1
  ENST ID: ENST00000446128
  CDS Start-End: 176-550
gtgcctccctggacgtctccaggggcggtcacgcggaatgctggtccccgcagtttcggccattggcccctccacttcggcgccccgccttccccctgggctcaggtgtaatcgtggatctagggtgtgggcacctgggatgaagtagtgaaggcggcgggcgctaggggaaaagatgccgttccaccatgtgaccgccggcttgttgtacaaggggaattacctcaaccgatcgctctctgctggcagtgacagcgaacagctggctaatatctccgtggaggagctcgatgaaatccgagaggcctttcgggttctggaccgggatgggaacggcttcatctccaagcaggagctgggcatggccatgcgctctttggggtacatgccaagcgaggtggagctggccatcatcatgcagcgcttggacatggacggggatggccaggtggattttgatgaattcatgaccattcttggccccaaactggtgtcttcagaaggtcgcgatggttttcttgggaacacgatagacagcatattctggcag

SEQ ID NO: 113540 - DNA, 4260 bp, Homo sapiens
  Payload ID: 2195
  Gene Symbol: CANX
  Gene Name: calnexin
  Uniprot ID: P27824
  ENST ID: ENST00000247461
  CDS Start-End: 201-1979
actcaggggccaggggcgggcacagggccgggcttcgtgcggtggggctcgctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtc

SEQ ID NO: 113541 - DNA, 4207 bp, Homo sapiens
  Payload ID: 2195
  Gene Symbol: CANX
  Gene Name: calnexin
  Uniprot ID: P27824
  ENST ID: ENST00000452673
  CDS Start-End: 148-1926
actcaggggccaggggcgggcacagggccgggcttcgtgcggtggggctcgctcgcgcggcagcggtggccgaggcctcttggttctgcggcacgtgacggtcgggccgcctccgcctctctctttactgcggcgcggggcaagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaacttttttttttttaacatctttgtttttaaaatagaatgatagaactttgccagtctttaagatcttggcttaatttaatgtattaatctgtttgtgcaaacataataccaccatttaaaaatgttagggagatgagttgcagtttttataatagattttttttaaagtttggtattgtaaaacattcacacctctgtccctcaaaattgataattacgtttaaagtgcagtcatttgtggttagaatcttgttttgtttgcttccattattgagttcctcctaaggaaattgaggagagggactgaatagaagcccaaattcatataaaagttgcgtttaagttgtattaaaaatagatatataagaaaaaattctttcacttgatgtttgttagaccagaaagtgtgtgtgttctgtagctcagttcccagacagctttttaggtagtggaggaggtggcttcatgtggcacttgggcatttatattccacttgggagggtcaggctgtggccttctggagcaggtggcttgttaaggaatgctagcagggcatggcacgtgagctccggaatagatgtcttcatcacttcttccactgtgtgttgacactgttttccttacctatttcctcagatccccagctttctcctctgctatgcattttcttcacagtgcagcttgcagtccgttgctgaaaatgattataagccctgcataatgttaagctttattgtgattacgtgtatgtttcttctttcttttaagcagacccatacctttccagggtcaaagtacagaatagaatacattgatacaaagtacagaaaaatactttgatttttatccatttcttttactctgtgtaaagacttgagaagtctaattcacaggcaaaccaatacagaattgactgcagttgaacagactagaagtatttgtgggaggagtgacatgaagcatgagttatctgattttttttgtagctgctatatattttaagccttcatttgcaattcatgtaacagttgtgtcataaattacacaataaagcagtcctgttcaaatttttttttaacgtggcttgtagaatttttaaaaaagtgatcttaggtttgttttttcatgcgggatgcagatgggtgctatcagagcctctcccacaccactatagtgtaataatgttattattactctacactgaaacgtattcagagttagatattattttagcttcagttgttctttagaggctttcaaatgtaccgatgatactgtttcttgcactgaatatataaacactccacagtgtttatattgggaagatattgggaaggaaatatatttgtaaaagatgaaggctgtatctatttttttttctttttaaagtttgttcacttaaattcttttgaggatgggatgtatttttcttgctgttcagtgctttttccttttcatctgttgttctgtggtcacagtgaccttagctacatagcagactttcccaaatgtattgattacaaataaacagttgttacttagcaagacctgaaaatatgtctgcaggtttctccttgaagcaaatgtgtgggatcattgcatttccagaaatctgcctccttcaccctccgttgacagtatatgtcatgcctcactttcttctagctgagctttaaatcattagagcttaaattgtcagatcgttcattgcctttccagggttatttagtaaagtttgttgaaaacaaaaacgccttttcttggttcttttttcagttattttgaaggtccagcatcctgattaaatgtctgacacattaatgaatgaccagcagcagctttcagctcttaaaaagacacttatattttgattttacatgctggttacctgttccattgttgtcaaatgcccactctccatcagatgtgttcctccattttcttatccacaaagtactcctcacttttcaatttgtcatgttactaaatggtgttacattaaagccctgtgttaagtgtc

SEQ ID NO: 113542 - DNA, 1000 bp, Homo sapiens
  Payload ID: 2195
  Gene Symbol: CANX
  Gene Name: calnexin
  ENST ID: ENST00000502673
  CDS Start-End: 77-1000
gaggcctcttggttctgcggcacgtgacggtcgggccgcctccgcctctctctttactgcggcgcggggcaagatcatggaagggaagtggttgctgtgtatgttactggtgcttggaactgctattgttgaggctcatgatggacatgatgatgatgtgattgatattgaggatgaccttgacgatgtcattgaagaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacct

SEQ ID NO: 113543 - DNA, 569 bp, Homo sapiens
  Payload ID: 2195
  Gene Symbol: CANX
  Gene Name: calnexin
  ENST ID: ENST00000509563
  CDS Start-End: 474-569
gggcatgacacaagtgattgctggttgagggaagttaaactgagcttaatattaaaagattgagaggacaagattaaccatagttaagtctttttacctctgatttaggaaatggaagattttgcttaattttttaataagtagatttttttaagggggaagaattttattgatctttaaaatcattctgtatctcagtcttttcccaacattgtttgagggtcatgaatagaagcaactgccatatggatcaactgttgtacatttggtataattatacttagagcagaggtaaaggactatgtgggagttctcctgtgcatcagccagggtgcacacacaagccagacggagtctcgctctgtcactcaggctggagtgcagtggcgcgatctcggctcactgcaagctccgcctcccgggttcacgccattctcctgcctcagcctcccttgtagctgggactacagatcatggaagggaagtggttgctgtgtatgttactggtgcttggaactgctattgttgaggctcatgatggacatgatgatgatgtgattgatattgag

SEQ ID NO: 113544 - DNA, 727 bp, Homo sapiens
  Payload ID: 2195
  Gene Symbol: CANX
  Gene Name: calnexin
  ENST ID: ENST00000513246
  CDS Start-End: 406-727
gaggcctcttggttctgcggcacgtgacggtcgggccgcctccgcctctctctttactgcggcgcggggcaaggtgtgcgggcgggaaggggcacgggcacccccgcggtccccgggaggctagagatctgtggtcctccgtggaaagagagccactaccccaagacacatctaatataatacacagggcgcttacgtggttagaaaagaagagataagccgggtgcggtggctcactcctgtaatcccagcactttggaaggccgaggcgggcagatcacgacgtcaagagattgagactatcctggccaacacggtgaaaccctgtctctattaaaaataacaaaaattagctggatgtggtggtgcacacctgtcatcccacctacttgggaggctgagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagagg

SEQ ID NO: 113545 - DNA, 2232 bp, Homo sapiens
  Payload ID: 2195
  Gene Symbol: CANX
  Gene Name: calnexin
  Uniprot ID: P27824
  ENST ID: ENST00000504734
  CDS Start-End: 191-1969
agtgcacgccaatccggccaggcgctcgcgctgggttctgctcacgcccgtaggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacggatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccctcctcccctgcaagagtggtcctaggagaggacctggcacaccttaggttgacattcagaaaacttcaagacatcaccatcagcaggctccagttgaacactagtctgtgtaactttaaacatctagcagtaaatacttgcagttgtgatataaaggaccctgtttctgtagaaaagaaaacatttaacataatggttgtgaaatgtaacatgaagcaaactaact

SEQ ID NO: 113546 - DNA, 568 bp, Homo sapiens
  Payload ID: 2195
  Gene Symbol: CANX
  Gene Name: calnexin
  ENST ID: ENST00000508787
  CDS Start-End: 1-568
aaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaaaaagccgagggactaatcatttatgtttcgtgcataaggaaatgggcgttagcttccccaagaccccaggagccaggcattgttcttaccccaaagcctcagtcttgaatccagataatagttttgaaatactggttgaccaatctgtggtgaatagtggaaatctgctcaatgacatgactcctcctgtaaatccttc

SEQ ID NO: 113547 - DNA, 585 bp, Homo sapiens
  Payload ID: 2195
  Gene Symbol: CANX
  Gene Name: calnexin
  ENST ID: ENST00000514383
  CDS Start-End: 154-585
gctggcgcctgcgcgcttgcgcatcttcctctgcccggcgcgcgccgcagccgtcgggatcacctcggggttgcgctgcttctccagcaagtgcatgcgcgccatggtctcagtcagcatgtctatgagcagttcctgctgcagcttcagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaag

SEQ ID NO: 113548 - DNA, 511 bp, Homo sapiens
  Payload ID: 2195
  Gene Symbol: CANX
  Gene Name: calnexin
  ENST ID: ENST00000510810
  CDS Start-End: 1-511
ctctttactgcggcgcggggcaaggtgtgcgggcgggaaggggcacgggcacccccgcggtccccgggaggctagaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcactt

SEQ ID NO: 113549 - DNA, 825 bp, Homo sapiens
  Payload ID: 2195
  Gene Symbol: CANX
  Gene Name: calnexin
  ENST ID: ENST00000502296
  CDS Start-End: 424-825
cagcgcggagcagtgcacgccaatccggccaggcgctcgcgctgggttctgctcacgcccgtaggggcccgcgttcgctgcaacgggcccttcctgatggccgatcgtcggactcctaccccttttgccggctgccgtttgccccgtcagcgaagggcgcgcgatgcgtcccaagtctcggctccaggaaccagacgggtgagggctactgggggttgggttggaacgccccgaaggcaccacagcaaccgacgcgggaacgcctgttaaaccagccccgccccgagacgcgcgcgcccggcggtctcgatccagcgtggcccgcccctcacctcccgcccaaccaacagccacttcctgcctcactcccggccaatcttcacactccacgaagaatagccgtagggggcgtatgggacgatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaa

SEQ ID NO: 113550 - DNA, 570 bp, Homo sapiens
  Payload ID: 2195
  Gene Symbol: CANX
  Gene Name: calnexin
  ENST ID: ENST00000502498
  CDS Start-End: 66-570
gcggtggggctcgctcgcgcggcagcggtggccgaggcctcttggttctgcggcacgtgacgatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgcttt

SEQ ID NO: 113551 - DNA, 582 bp, Homo sapiens
  Payload ID: 2195
  Gene Symbol: CANX
  Gene Name: calnexin
  ENST ID: ENST00000507307
  CDS Start-End: 347-582
gctcgcgcggcagcggtggccgaggcctcttggttctgcggcacgtgacggtcgggccgcctccgcctctctctttactgcggcgcggggcaaggtgtgcgggcgggaaggggcacgggcacccccgcggtccccgggaggctagagcggagactggaccctagttccctgaagagaaaggggaatgtaccagaaggagaacacgcagtggttgagaaacttagcagttacagcacctattctggaggcgagtaatccagttggagagggacagggcgttaaaagcaggaaagcccccgaaagctcatctaagtgcatctctttccacaccggaggcctggagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaac

SEQ ID NO: 113552 - DNA, 533 bp, Homo sapiens
  Payload ID: 2195
  Gene Symbol: CANX
  Gene Name: calnexin
  ENST ID: ENST00000504579
  CDS Start-End: 139-324
gcggtggccgaggcctcttggttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctg

SEQ ID NO: 113553 - DNA, 592 bp, Homo sapiens
  Payload ID: 2195
  Gene Symbol: CANX
  Gene Name: calnexin
  ENST ID: ENST00000506654
  CDS Start-End: 199-592
cttggttctgcggcacgtgacggtcgggccgcctccgcctctctctttactgcggcgcggggcaaggtgtgcgggcgggaaggggcacgggcacccccgcggtccccgggaggctagaggtggattttatccaaagccaagaaagacgataccgatgatgaaattgccaaatatgatggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacac

SEQ ID NO: 113554 - DNA, 1876 bp, Homo sapiens
  Payload ID: 2195
  Gene Symbol: CANX
  Gene Name: calnexin
  ENST ID: ENST00000514032
  CDS Start-End: 119-409
gttctgcggcacgtgacggtcgggccgcctccgcctctctctttactgcggcgcggggcaaggtgtgcgggcgggaaggggcacgggcacccccgcggtccccgggaggctagagatcatggaagggaagtggttgctgtgtatgttactggtgcttggaactgctattgttgaggctcatgatggacatgatgatgatgtgattgatattgaggatgaccttgacgatgtcattgaagaggtagaagactcaaaaccagataccactgctcctccttcatctcccaaggttacttacaaagctccagttccaacaggggaagtatattttgctgattcttttgacagaggaactctgtcagggaaagtgggaggtagaggaaatgaaggagtcaaagcttccaggtgataaaggacttgtgttgatgtctcgggccaagcatcatgccatctctgctaaactgaacaagcccttcctgtttgacaccaagcctctcattgttcagtatgaggttaatttccaaaatggaatagaatgtggtggtgcctatgtgaaactgctttctaaaacaccagaactcaacctggatcagttccatgacaagaccccttatacgattatgtttggtccagataaatgtggagaggactataaactgcacttcatcttccgacacaaaaaccccaaaacgggtatctatgaagaaaaacatgctaagaggccagatgcagatctgaagacctattttactgataagaaaacacatctttacacactaatcttgaatccagataatagttttgaaatactggttgaccaatctgtggtgaatagtggaaatctgctcaatgacatgactcctcctgtaaatccttcacgtgaaattgaggacccagaagaccggaagcccgaggattgggatgaaagaccaaaaatcccagatccagaagctgtcaagccagatgactgggatgaagatgcccctgctaagattccagatgaagaggccacaaaacccgaaggctggttagatgatgagcctgagtacgtacctgatccagacgcagagaaacctgaggattgggatgaagacatggatggagaatgggaggctcctcagattgccaaccctagatgtgagtcagctcctggatgtggtgtctggcagcgacctgtgattgacaaccccaattataaaggcaaatggaagcctcctatgattgacaatcccagttaccagggaatctggaaacccaggaaaataccaaatccagatttctttgaagatctggaacctttcagaatgactccttttagtgctattggtttggagctgtggtccatgacctctgacattttttttgacaactttatcatttgtgctgatcgaagaatagttgatgattgggccaatgatggatggggcctgaagaaagctgctgatggggctgctgagccaggcgttgtggggcagatgatcgaggcagctgaagagcgcccgtggctgtgggtagtctatattctaactgtagcccttcctgtgttcctggttatcctcttctgctgttctggaaagaaacagaccagtggtatggagtataagaaaactgatgcacctcaaccggatgtgaaggaagaggaagaagagaaggaagaggaaaaggacaagggagatgaggaggaggaaggagaagagaaacttgaagagaaacagaaaagtgatgctgaagaagatggtggcactgtcagtcaagaggaggaagacagaaaacctaaagcagaggaggatgaaattttgaacagatcaccaagaaacagaaagccacgaagagagtgaaacaatcttaagagcttgatctgtgatttcttctccct

SEQ ID NO: 113555 - DNA, 3007 bp, Homo sapiens
  Payload ID: 2196
  Gene Symbol: CAPN1
  Gene Name: calpain 1, (mu/I) large subunit
  Uniprot ID: P07384
  ENST ID: ENST00000279247
  CDS Start-End: 144-2288
aaggagagagggagggcggagggcggaggggcggcgggaggagggcggggaggagcgctcttcctggttgggccctgccctgagctgccaccgggaagccagcctcagggactgcagcgacccccaaacacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtg

SEQ ID NO: 113556 - DNA, 564 bp, Homo sapiens
  Payload ID: 2196
  Gene Symbol: CAPN1
  Gene Name: calpain 1, (mu/I) large subunit
  ENST ID: ENST00000527699
  CDS Start-End: 109-564
actacagagctgcaagcccctgacaatgggatccgggaaaggagaggtggccggcacgcctgggaactgggaaatccctttcctggattcactgggagcaccgggaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccag

SEQ ID NO: 113557 - DNA, 550 bp, Homo sapiens
  Payload ID: 2196
  Gene Symbol: CAPN1
  Gene Name: calpain 1, (mu/I) large subunit
  ENST ID: ENST00000526966
  CDS Start-End: 66-550
ctaatttgtcctctcgcggaattggcccccggcctgcggagggaggggcggggagacaccgtgagatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgt

SEQ ID NO: 113558 - DNA, 2792 bp, Homo sapiens
  Payload ID: 2196
  Gene Symbol: CAPN1
  Gene Name: calpain 1, (mu/I) large subunit
  Uniprot ID: P07384
  ENST ID: ENST00000533129
  CDS Start-End: 76-2220
ctctcgcggaattggcccccggcctgcggagggaggggcggggagacaccgtgagtaagagatagtcagagaccgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctcc

SEQ ID NO: 113559 - DNA, 581 bp, Homo sapiens
  Payload ID: 2196
  Gene Symbol: CAPN1
  Gene Name: calpain 1, (mu/I) large subunit
  ENST ID: ENST00000534373
  CDS Start-End: 175-581
gttgggccctgccctgagctgccaccgggaagccagcctcagggactgcagcgacccccaaacacccctcccccagttccttgtgctgtctggaggctccgccctgccccacctgacctgctggctcactacagagctgcaagcccctgacaatgggatccgggaaaggagaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttcc

SEQ ID NO: 113560 - DNA, 3086 bp, Homo sapiens
  Payload ID: 2196
  Gene Symbol: CAPN1
  Gene Name: calpain 1, (mu/I) large subunit
  Uniprot ID: P07384
  ENST ID: ENST00000527323
  CDS Start-End: 241-2385
gggatccgggaaaggagaggtggccggcacgcctgggaactgggaaatccctttcctggattcactgggagcaccgggaggtggctgagaaccctacttctgtgaggggagcagtgaggcagggaaaccctaggtttggggatggataagcaggggcaggagagcagagcttgcaggcaggagcccaggttctagtcttgggaaggcctgggttctgagcaggcccatctgtccggcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaag

SEQ ID NO: 113561 - DNA, 593 bp, Homo sapiens
  Payload ID: 2196
  Gene Symbol: CAPN1
  Gene Name: calpain 1, (mu/I) large subunit
  ENST ID: ENST00000529133
  CDS Start-End: 21-593
gacacatgggcgcttccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgctt

SEQ ID NO: 113562 - DNA, 690 bp, Homo sapiens
  Payload ID: 2196
  Gene Symbol: CAPN1
  Gene Name: calpain 1, (mu/I) large subunit
  ENST ID: ENST00000526468
  CDS Start-End: 117-690
agattcctgggtcttttctgcaagctgaggggagttaagtggcaccctggccaaggaaccccagattctccctagcacccgcttccccccccggggcaggttggtagagcaggctaatgtgcatccctcctgccccaggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacc

SEQ ID NO: 113563 - DNA, 582 bp, Homo sapiens
  Payload ID: 2196
  Gene Symbol: CAPN1
  Gene Name: calpain 1, (mu/I) large subunit
  ENST ID: ENST00000527739
  CDS Start-End: 98-582
gcgctggcccctccccggggactgctctgccttttactaatttgtcctctcgcggaattggcccccggcctgcggagggaggggcggggagacaccgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgt

SEQ ID NO: 113564 - DNA, 2960 bp, Homo sapiens
  Payload ID: 2196
  Gene Symbol: CAPN1
  Gene Name: calpain 1, (mu/I) large subunit
  Uniprot ID: P07384
  ENST ID: ENST00000524773
  CDS Start-End: 101-2245
tggcccccggcctgcggagggaggggcggggagacaccgtgagtaagagatagtcagagaccgtgccggagagataagggagagccgagaggaagcggggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtc

SEQ ID NO: 113565 - DNA, 496 bp, Homo sapiens
  Payload ID: 2196
  Gene Symbol: CAPN1
  Gene Name: calpain 1, (mu/I) large subunit
  ENST ID: ENST00000531068
  CDS Start-End: 130-496
actacagagctgcaagcccctgacaatgggatccgggaaaggagaggtggccggcacgcctgggaactgggaaatccctttcctggattcactgggagcaccgggaggtggctgagaaccctacttctgatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcct

SEQ ID NO: 113566 - DNA, 573 bp, Homo sapiens
  Payload ID: 2196
  Gene Symbol: CAPN1
  Gene Name: calpain 1, (mu/I) large subunit
  ENST ID: ENST00000533909
  CDS Start-End: 129-573
cctgacaatgggatccgggaaaggagaggtggccggcacgcctgggaactgggaaatccctttcctggattcactgggagcaccgggaggtggctgagaaccctacttctgtgaggggagcagtgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatct

SEQ ID NO: 113567 - DNA, 3083 bp, Homo sapiens
  Payload ID: 2196
  Gene Symbol: CAPN1
  Gene Name: calpain 1, (mu/I) large subunit
  Uniprot ID: P07384
  ENST ID: ENST00000533820
  CDS Start-End: 219-2363
gaaagtcgggccgaacggggcagggacttacccaaggtcacgcagcgagcccggtccccctgcgttccccggggagcgctgagccgggacgcggcggtggggtggggaaggggagtggcgcggccctgcggggtgaggctgccgtttgctgagtgtccggcaggggtctgctcgctgccagcccggcccctcctcagagcagctgccgcagcccgaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaggtaaatggcagctacgaggccctgtcagggggcagcacctcagagggctttgaggacttcacaggcggggttaccgagtggtacgagttgcgcaaggctcccagtgacctctaccagatcatcctcaaggcgctggagcggggctccctgctgggctgctccatagacatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtggacgggagcctggagcgacagctcctcagagtggaacaacgtggacccatatgaacgggaccagctccgggtcaagatggaggacggggagttctggatgtcattccgagacttcatgcgggagttcacccgcctggagatctgcaacctcacacccgacgccctcaagagccggaccatccgcaaatggaacaccacactctacgaaggcacctggcggcgggggagcaccgcggggggctgccgaaactacccagccaccttctgggtgaaccctcagttcaagatccggctggatgagacggatgacccggacgactacggggaccgcgagtcaggctgcagcttcgtgctcgcccttatgcagaagcaccgtcgccgcgagcgccgcttcggccgcgacatggagactattggcttcgcggtctacgaggtccctccggagctggtgggccagccggccgtacacttgaagcgtgacttcttcctggccaatgcgtctcgggcgcgctcagagcagttcatcaacctgcgagaggtcagcacccgcttccgcctgccacccggggagtatgtggtggtgccctccaccttcgagcccaacaaggagggcgacttcgtgctgcgcttcttctcagagaagagtgctgggactgtggagctggatgaccagatccaggccaatctccccgatgagcaagtgctctcagaagaggagattgacgagaacttcaaggccctcttcaggcagctggcaggggaggacatggagatcagcgtgaaggagttgcggacaatcctcaataggatcatcagcaaacacaaagacctgcggaccaagggcttcagcctagagtcgtgccgcagcatggtgaacctcatggatcgtgatggcaatgggaagctgggcctggtggagttcaacatcctgtggaaccgcatccggaattacctgtccatcttccggaagtttgacctggacaagtcgggcagcatgagtgcctacgagatgcggatggccattgagtcggcaggcttcaagctcaacaagaagctgtacgagctcatcatcacccgctactcggagcccgacctggcggtcgactttgacaatttcgtttgctgcctggtgcggctagagaccatgttccgatttttcaaaactctggacacagatctggatggagttgtgacctttgacttgtttaagtggttgcagctgaccatgtttgcatgaggcagggactcggtcccccttgccgtgctcccctccctcctcgtctgccaagcctcgcctcctaccacaccacaccaggccaccccagctgcaagtgccttccttggagcagagaggcagcctcgtcctcctgtcccctctcctcccagccaccatcgttcatctgctccgggcagaactgtgtggcccctgcctgtgccagccatgggctcgggatggactccctgggccccacccattgccaagccaggaaggcagctttcgcttgttcctgcctcgggacagccccgggtttccccagcatcctgatgtgtcccctctccccacttcagaggccacccactcagcaccaccggcctggccttgcctgcagactataaactataaccactagctcgacacagtctgcagtccaggcgtgtggagccgcctcccggctcggggaggccccggggctgggaacgcctgtgccttcctgcgccgaagccaacgccccctctgtccttccctggccctgctgccgaccaggagctgcccagcctgtgggcggtcggccttccctccttcgctccttttttatattagtgattttaaaggggactcttcagggacttgtgtactggttatgggggtgccagaggcactaggcttggggtggggaggtcccgtgttccatatagaggaaccccaaataataaaaggccccacatctgtctgtga

SEQ ID NO: 113568 - DNA, 571 bp, Homo sapiens
  Payload ID: 2196
  Gene Symbol: CAPN1
  Gene Name: calpain 1, (mu/I) large subunit
  ENST ID: ENST00000528396
  CDS Start-End: 82-571
acccttctctgtccctggacacctgcgcagaaagcctaggagctggttccacccatcactcaccaggttaggtatttcaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcg

SEQ ID NO: 113569 - DNA, 754 bp, Homo sapiens
  Payload ID: 2196
  Gene Symbol: CAPN1
  Gene Name: calpain 1, (mu/I) large subunit
  ENST ID: ENST00000526954
  CDS Start-End: 16-621
cacccctcccccaggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccggtaccccagagcctgggttacaaggacctgggtcccaattcctccaagacctatggcatcaagtggaagcgtcccacggaactgctgtcaaacccccagttcattgtggatggagctacccgcacagacatctgccagggagcactgggggactgctggctcttggcggccatcgcctccctcactctcaacgacaccctcctgcaccgagtggttccgcacggccagagcttccagaatggctatgccggcatcttccatttccagctgtggcaatttggggagtgggtggacgtggtcgtggatgacctgctgcccatcaaggacgggaagctagtgttcgtgcactctgccgaaggcaacgagttctggagcgccctgcttgagaaggcctatgccaaatctccagcgttctagacatggaggccatcactttcaagaagttggtgaagggccatgcctactctgtgaccggggccaagcaggtgaactaccgaggccaggtggtgagcctgatccggatgcggaacccctggggcgaggtggagtg

SEQ ID NO: 113570 - DNA, 568 bp, Homo sapiens
  Payload ID: 2196
  Gene Symbol: CAPN1
  Gene Name: calpain 1, (mu/I) large subunit
  ENST ID: ENST00000532285
  CDS Start-End: 380-568
cttcctggttgggccctgccctgagctgccaccgggaagccagcctcagggactgcagcgacccccaaacacccctcccccaggtaagaagctgggtagccgagccgggattccttgaccctggccactgctcctgggctgaggggctgccccagcacggtcccttctcgggggcctctgcgttcctggagcaggggtgggggctggcggagcggcacagcccaggcgcctgtcccagcctggctcaccgctgtccccaggggctgggctagggcccaccagctctgatatcgagcctgctgcgggggcctgaggagggggaccccgaccgtctggggttttcagcccacggcaaggggccggtgcaccaggagcttggatgtcggaggagatcatcacgccggtgtactgcactggggtgtcagcccaagtgcagaagcagcgggccagggagctgggcctgggccgccatgagaatgccatcaagtacctgggccaggattatgagcagctgcgggtgcgatgcctgcagagtgggaccctcttccgtgatgaggccttccccccg

SEQ ID NO: 113571 - DNA, 2453 bp, Homo sapiens
  Payload ID: 2197
  Gene Symbol: CAPN10
  Gene Name: calpain 10
  Uniprot ID: Q9HC96
  ENST ID: ENST00000270361
  CDS Start-End: 42-866
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaagggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaac

SEQ ID NO: 113572 - DNA, 1999 bp, Homo sapiens
  Payload ID: 2197
  Gene Symbol: CAPN10
  Gene Name: calpain 10
  Uniprot ID: Q9HC96
  ENST ID: ENST00000354082
  CDS Start-End: 42-1595
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaac

SEQ ID NO: 113573 - DNA, 1267 bp, Homo sapiens
  Payload ID: 2197
  Gene Symbol: CAPN10
  Gene Name: calpain 10
  Uniprot ID: Q9HC96
  ENST ID: ENST00000270364
  CDS Start-End: 141-560
gcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtctcttgccctgtgcagcttcctgcagactggacttgcaaagtccagcctgtatggctggagttcccatgcctgccaatctcctgtcgactgcgagtcagctccgatacttcaccagattcagccacctgggggagctggaagtgaatctcatcttagctgagccttctgatgagactgcagccccagctgacacctggattgcagactcatgaaagacctgaaactctaccaacagccacctgggggagctggaagtgaatctcctcgtagctgagccttctgatgagactgcagccccggctgacacctggattgcagactcatgaaagacctgaaactctaccaacagccacctgggggagctggaagtgaatctcctcgtagctgagccttctgatgagactgcagccccggctgacacctggattgcagactcatgaaagaccctgagcagaggacccagtttggcagagcccgaattcctgacccacaggaactgggagataaaactctgtggttttaatcttctcattttagaggtaatttttttgtgtagcaataggtagctgacaatgcacagctaaaataatagataattaaccctaatgctagtttcattcatccatcagggtttgcaaagtagtgatattctacttctgtcttccttcattatttattagcagaaatgtatctataaaaagaagtgttccttcattaactctttggtcatgttgaggtacagtttgcataggaaaggcagggcaaatgcttgattctttcccttcctttcctcatttataaaataatgaactgttttcctggcatctttcaacaatgactaatgagttttt

SEQ ID NO: 113574 - DNA, 862 bp, Homo sapiens
  Payload ID: 2197
  Gene Symbol: CAPN10
  Gene Name: calpain 10
  Uniprot ID: Q9HC96
  ENST ID: ENST00000352879
  CDS Start-End: 42-458
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaac

SEQ ID NO: 113575 - DNA, 2202 bp, Homo sapiens
  Payload ID: 2197
  Gene Symbol: CAPN10
  Gene Name: calpain 10
  Uniprot ID: Q9HC96
  ENST ID: ENST00000357048
  CDS Start-End: 42-1583
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaac

SEQ ID NO: 113576 - DNA, 2320 bp, Homo sapiens
  Payload ID: 2197
  Gene Symbol: CAPN10
  Gene Name: calpain 10
  Uniprot ID: Q9HC96
  ENST ID: ENST00000391983
  CDS Start-End: 42-1676
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatca

SEQ ID NO: 113577 - DNA, 2644 bp, Homo sapiens
  Payload ID: 2197
  Gene Symbol: CAPN10
  Gene Name: calpain 10
  Uniprot ID: Q9HC96
  ENST ID: ENST00000391984
  CDS Start-End: 197-2215
cgcctggttaccaatgggagactagcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgcagatca

SEQ ID NO: 113578 - DNA, 2570 bp, Homo sapiens
  Payload ID: 2197
  Gene Symbol: CAPN10
  Gene Name: calpain 10
  ENST ID: ENST00000404753
  CDS Start-End: 174-2135
agcgggccggcgtactggcctggtccagcacctgcggggccctcgggcttggagggctgggccgggcggggaacgggcggggcgggccggaggcggcggcggctgactcgccttctctccggggctgcgaccccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaaggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagcgccatcagggcagtggccaagaacaccacccccggggcagccctgcctgcgggggagtgggggaccgtgcagctacggggttcttggagagtcggccagacggcggggggcagcaggaactttgcctcataccccaccaacccctgcttccccttctcggtccccgagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaacatgagcgctgatgatttgca

SEQ ID NO: 113579 - DNA, 2514 bp, Homo sapiens
  Payload ID: 2197
  Gene Symbol: CAPN10
  Gene Name: calpain 10
  Uniprot ID: Q9HC96
  ENST ID: ENST00000416591
  CDS Start-End: 42-1376
ccgaggcaaccggctgcagatgggagcccgcggagccgaggatgcgggcgggccggggcgcgacgccggcgagggagctgttccgggacgccgccttccccgccgcggactcctcgctcttctgcgacttgtctacgccgctggcccagttccgcgaggacatcacgtggaggcggccccaggagatttgtgccacaccccggctgtttccagatgacccacgggaagggcaggtgaagcaggggctgctgggggattgctggttcctgtgtgcctgcgccgcgctgcagaagagcaggcacctcctggaccaggtcattcctccgggacagccgagctgggccgaccaggagtaccggggctccttcacctgtcgcatttggcagtttggacgctgggtggaggtgaccacagatgaccgcctgccgtgccttgcagggagactctgtttctcccgctgccagagggaggatgtgttctggctccccttactggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcaggtgcccgggagctgggggagttccatgccttcattgtctcggacctgcgggagctccagggtcaggcgggccagtgcatcctgctgctgcggatccagaacccctggggccggcggtgctggcaggggctctggagagaggggggtgaagggtggagccaggtagatgcagcggtagcatctgagctcctgtcccagctccaggaaggggagttctgggtggaggaggaggagttcctcagggagtttgacgagctcaccgttggctacccggtcacggaggccggccacctgcagagcctctacacagagaggctgctctgccatacgcgggcgctgcctggggcctgggtcaagggccagtcagcaggaggctgccggaacaacagcggctttcccagcaaccccaaattctggctgcgggtctcagaaccgagtgaggtgtacattgccgtcctgcagagatccaggctgcacgcggcggactgggcaggccgggcccgggcactggtgggtgacagtcatacttcgtggagcccagcgagcatcccgggcaagcactaccaggctgtgggtctgcacctctggaagggtgtgacacttggcaccacactgttccctgtcccttcatggatgtggcccacatgatgttcctttcctcttgcaaaagaagttgctggaaggcccactgtccagcagcccccaggttgcctgggccacggtgcctttgtgggcccagctacaaggaggacttgcaggctcgtgtctgggacagatactggcgccagggccaagtgaagcccgggattggtagagaagcggcgggtcaatctgcctagggtcctgtccatgccccccgtggctggcaccgcgtgccatgcatacgaccgggaggtccacctgcgttgtgagctctcaccgggctactacctggctgtccccagcaccttcctgaaggacgcgccaggggagttcctgctccgagtcttctctaccgggcgagtctcccttagggccctggcccccgctgcgtccgcatcactctgcatcagcactgccggcccagtgacaccgagttccaccccatcggcttccatatcttccaggtcccagagggtggaaggagccaggacgcacccccactgctgctgcaggagccgctgctgagctgcgtgccacatcgctacgcccaggaggtgagccggctctgcctcctgcctgcgggcacctacaaggttgtgccctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcaggtgactggagcccgagggcctgacaggttcccagcagctgggccggccagccttgcactgtgggggctggtcctgagtcttggcctgcctcccagccctgccaggaggctgcggcctaggggtccacgggaagcctccgtcaggagagacgcagccctgggggccagctggtgctgcaaggaagggtgggaagcttgctggcttctgttgcgccactgagacggcagagaccccaggatcccagagcttcccaggatccctcccagatcctctgctgactccatatggaggcctcacacccagagggtagggcagcagatcttctttataactatttattgttcgaatcacttttaggatgtaactttataaataaac

SEQ ID NO: 113580 - DNA, 706 bp, Homo sapiens
  Payload ID: 2197
  Gene Symbol: CAPN10
  Gene Name: calpain 10
  ENST ID: ENST00000426297
  CDS Start-End: 1-140
cctccacctacctgccggacacagagggggccttcacagtgaccatcgcaaccaggattgacaggccatccattcacagccaggagatgctgggccagttcctccaagaggtctccatcatggcagtgatgaaaacctaacagggtggccccctgtgccagctcagctgacatgggctcattgctccttctccaagccctctgaggacatcaaaagcgtggacgcatcactttccaccatcttgctgcccactgtccctccatcctgaggcctcctaagcacatgtgtggggtggcaggcacactgctgatagctgtggatgcggccgtgacatccttcacccctgcccccatggcatgcatgatccattagggaggaccgtctgcacaaaggatctcactctgtttgtccaggctgaagtccagtggcaggatttcagctcactgcagcctcaacctcctgggctcaggtgattctcccaccttagcctcccgagtagctgggactacaagcacagatcaccacacctggctaattttttgcatttttgttttttagtagaaacagggtttcgctatgttgcccaggctagtctcaaacgcctggactccaacaatccacccaccttggcctcccggagtgctgggattataggctggggccactgtgctgaaccctgtccatttatttggatcttctttaattt

SEQ ID NO: 113581 - DNA, 638 bp, Homo sapiens
  Payload ID: 2197
  Gene Symbol: CAPN10
  Gene Name: calpain 10
  ENST ID: ENST00000432084
  CDS Start-End: 1-258
ctggaaaaggtctacgccaaggtccatgggtcctacgagcacctgtgggccgggcaggtggcggatgccctggtggacctgaccggcggcctggcagaaagatggaacctgaagggcgtagcaggaagcggaggccagcaggacaggccaggccgctgggagcacaggacttgtcggcagctgctccacctgaaggaccagtgtctgatcagctgctgcgtgctcagccccagagcagtgatagataacattcgttaaaaacagtttgtctccaaaaaatgaaaggggccaggtgtggtggctcacacctgtaatcccagaactttgggaggctgaggtgggagtatcgctggagcccaggagttcaagagacccgcctgggcaacatggcaagatctcatctctacaaaaaatgaaggaaaaaaatcacttagatggaaccacatgtgacttttgagtgcgctctcagttttccatgagcacgcacggtttacgtgttcccttccgcaccgcttctcacactgccacacacgcgctgtcaaatgttcgccccatgagcgggtttgccacagtctcttaatcattcccctgatgttggatattaagatctctctggttttatataattataagcagta

SEQ ID NO: 113582 - DNA, 2728 bp, Homo sapiens
  Payload ID: 2198
  Gene Symbol: CAPN11
  Gene Name: calpain 11
  Uniprot ID: Q9UMQ6
  ENST ID: ENST00000398776
  CDS Start-End: 39-2258
agaaccttcaactgtcaagcaccgagctagccaccagcatgctgtactccccagggccgagtcttccggagtcagcagagagcctggatggatcacaggaggataagcctcggggctcatgtgcggagcccacttttactgatacgggaatggtggctcacataaacaacagccggctcaaggccaagggcgtgggccagcacgacaacgcccagaactttggtaaccagagctttgaggagctgcgagcagcctgtctaagaaagggggagctcttcgaggaccccttattccctgctgaacccagctcactgggcttcaaggacctgggccccaactccaaaaatgtgcagaacatctcctggcagcggcccaaggatatcataaacaaccctctattcatcatggatgggatttctccaacagacatctgccaggggatcctcggggactgctggctgctggctgccatcggctcccttaccacctgccccaaactgctataccgcgtggtgcccagaggacagagcttcaagaaaaactatgctggcatcttccattttcagatttggcagtttggacagtgggtgaacgtggtggtagatgaccggctgcccacaaagaatgacaagctggtgtttgtgcactcaaccgaacgcagtgagttctggagtgccctgctggagaaggcgtatgccaagctgagtgggtcctatgaagcattgtcagggggcagtaccatggagggccttgaggacttcacaggaggcgtggcccagagcttccaactccagaggccccctcagaacctgctcaggctccttaggaaggccgtggagcgatcctccctcatgggttgctccattgaagtcaccagtgatagtgaactggaatccatgactgacaagatgctggtgagagggcacgcttactctgtgactggccttcaggatgtccactacagaggcaaaatggaaacactgattcgggtccggaatccctggggccggattgagtggaatggagcttggagtgacagtgccagggagtgggaagaggtggcctcagacatccagatgcagctgctgcacaagacggaggacggggagttctggatgtcctaccaagatttcctgaacaacttcacgctcctggagatctgcaacctcacgcctgatacactctctggggactacaagagctactggcacaccaccttctacgagggcagctggcgcagaggcagctccgcagggggctgcaggaaccaccctggcacgttctggaccaacccccagtttaagatctctcttcctgagggggatgacccagaggatgacgcagagggcaatgttgtggtctgcacctgcctggtggccctaatgcagaagaactggcggcatgcacggcagcagggagcccagctgcagaccattggctttgtcctctacgcggtcccaaaagagtttcagaacattcaggatgtccacttgaagaaggaattcttcacgaagtatcaggaccacggcttctcagagatcttcaccaactcacgggaggtgagcagccaactccggctgcctccgggggaatatatcattattccctccacctttgagccacacagagatgctgacttcctgcttcgggtcttcaccgagaagcacagcgagtcatgggaattggatgaagtcaactatgctgagcaactccaagaggaaaaggtctctgaggatgacatggaccaggacttcctacatttgtttaagatagtggcaggagagggcaaggagataggggtgtatgagctccagaggctgctcaacaggatggccatcaaattcaaaagcttcaagaccaagggctttggcctggatgcttgccgctgcatgatcaacctcatggataaagatggctctggcaagctggggcttctagagttcaagatcctgtggaaaaaactcaagaaatggatggacatcttcagagagtgtgaccaggaccattcaggcaccttgaactcctatgagatgcgcctggttattgagaaagcaggcatcaagctgaacaacaaggtaatgcaggtcctggtggccaggtatgcagatgatgacctgatcatagactttgacagcttcatcagctgtttcctgaggctaaagaccatgttcacattctttctaaccatggaccccaagaatactggccatatttgcttgagcctggaacagtggctgcagatgaccatgtggggatagaggcgctgtaggagcctggtcatctctaccagcagcagcagcagcgaggttctagcccaggagggtggggtgcttcttgtagccctcagctctccggtctctgctgatgaaatgggctccaggtggcagtgcccgggtcccaggtgccgtgtttactgcagcagtgggacctccgtgcccactcccccagctcagaggctttctcttttttccccaacccggcttctgatggctggctttcccccaccatcgctctctcagagtatattttactaaagagtagttgatgcttccccagggtccccctggctggggaggccaagaatagggaagggacttgtagcccgtttcttaccctccatgcttgctgtcctgctcacacctacctgctgaccacccatcctggcacagcctctgttttcctccccatctgtggatactattctaataaatagcacatgccattggct

SEQ ID NO: 113583 - DNA, 565 bp, Homo sapiens
  Payload ID: 2198
  Gene Symbol: CAPN11
  Gene Name: calpain 11
  ENST ID: ENST00000526118
  CDS Start-End: 30-152
aactgtcaagcaccgagctagccaccagcatgctgtactccccaggcccccaggagagctcaacaccctcagtcctcggagcagccagggtagaggctgcctggagtgactgcacggtgcaagggcatggagtggtttgccttatcgtgtgaatgaccttagatgattcgctcaacccagggccgagtcttccggagtcagcagagagcctggatggatcacaggaggataagcctcggggctcatgtgcggagcccacttttactgatacgggaatggtggctcacataaacaacagccggctcaaggccaagggcgtgggccagcacgacaacgcccagaactttggtaaccagagctttgaggagctgcgagcagcctgtctaagaaagggggagctcttcgaggaccccttattccctgctgaacccagctcactgggcttcaaggacctgggccccaactccaaaaatgtgcagaacatctcctggcagcggcccaaggatatcataaacaaccctctattcatcatggatgggatttctccaacagacatctgccaggg

SEQ ID NO: 113584 - DNA, 585 bp, Homo sapiens
  Payload ID: 2198
  Gene Symbol: CAPN11
  Gene Name: calpain 11
  ENST ID: ENST00000532171
  CDS Start-End: 39-585
agaaccttcaactgtcaagcaccgagctagccaccagcatgctgtactccccagggccgagtcttccggagtcagcagagagcctggatggatcacaggaggataagcctcggggctcatgtgcggagacaaggtcttgctctgtcacccagactggagtgccatcacatctcattgcagcctcaaactgccacagcctcgaactccagggctcagagcccacttttactgatacgggaatggtggctcacataaacaacagccggctcaaggccaagggcgtgggccagcacgacaacgcccagaactttggtaaccagagctttgaggagctgcgagcagcctgtctaagaaagggggagctcttcgaggaccccttattccctgctgaacccagctcactgggcttcaaggacctgggccccaactccaaaaatgtgcagaacatctcctggcagcggcccaaggatatcataaacaaccctctattcatcatggatgggatttctccaacagacatctgccaggggatcctcggggactgctggctgctggctgccatcggctcccttaccacctgcccca

SEQ ID NO: 113585 - DNA, 2762 bp, Homo sapiens
  Payload ID: 2199
  Gene Symbol: CAPN12
  Gene Name: calpain 12
  Uniprot ID: Q6ZSI9
  ENST ID: ENST00000328867
  CDS Start-End: 310-2469
actgacctccttcttggtgctctgacagcggcagccggtcctccctcagctctgcccgccttctctcctgctgctggccaagcccattaagctgctaccttggccacaactgaaggccccacgccctgggaagaaagctactgaagaggcgtccctgctccccagcaccccaaaccatcaattaatattaacgagggaaggctcctcattgcctaaagaccccactggggctccaatggaagagaggccccgcccccgtgactcaggaggttaaagggcctggtgccggcttgtgaggccagtgtccagatggcatccagcagtgggagggtcaccatccagctcgtggatgaggaggctggggtcggagccgggcgcctgcagctttttcggggccagagctatgaggcaattcgggcagcctgcctggattcggggatcctgttccgcgacccttacttccctgctggccctgatgcccttggctatgaccagctggggccggactcggagaaggccaaaggcgtgaaatggatgaggccccatgagttctgtgctgagccgaagttcatctgtgaagacatgagccgcacagacgtgtgtcaggggagcctgggtaactgctggttccttgcagctgccgcctcccttactctgtatccccggctcctgcgccgggtggtccctcctggacaggatttccagcatggctacgcaggcgtcttccacttccagctctggcagtttggccgctggatggacgtcgtggtggatgacaggctgcccgtgcgtgaggggaagctgatgttcgtgcgctcggaacagcggaatgagttctgggccccactcctggagaaggcctacgccaagctccacggctcctatgaggtgatgcggggcggccacatgaatgaggcttttgtggatttcacaggcggcgtgggcgaggtgctctatctgagacaaaacagcatggggctgttctctgccctgcgccatgccctggccaaggagtccctcgtgggcgccactgccctgagtgatcggggtgagtaccgcacagaagagggcctggtaaagggacacgcgtattccatcacgggcacacacaaggtgttcctgggcttcaccaaggtgcggctgctgcggctgcggaacccatggggctgcgtggagtggacgggggcctggagcgacagctgcccacgctgggacacactccccaccgagtgccgcgatgccctgctggtgaaaaaggaggatggcgagttctggatggagctgcgggacttcctcctccatttcgacaccgtgcagatctgctcgctgagcccggaggtgctgggccccagcccggaggggggcggctggcacgtccacaccttccaaggccgctgggtgcgtggcttcaactccggcgggagccagcctaatgctgaaaccttctggaccaatcctcagttccgtttaacgctgctggagcctgatgaggaggatgacgaggatgaggaagggccctgggggggctggggggctgcaggggcacggggcccagcgcgggggggccgcacgcccaagtgcacggtccttctgtccctcatccagcgcaaccggcggcgcctgagagccaagggcctcacttacctcaccgttggcttccacgtgttccagattccagaggagctgctgggcctctgggattccccgcgcagccatgcgctcctgccccggctgctgcgcgccgaccgctcgcccctcagcgcccgccgcgacgtgacccgccgctgctgcctgcgtccaggccactacctggtggtgccgagcaccgcccacgccggcgacgaggctgacttcactctgcgtgtcttctccgagcgccgccacacggccgtggagatcgacgacgtgatcagcgcagacctgcagtctctccagggcccctacctgcccctggagctggggttggagcagctgtttcaggagctggctggagaggaggaagaactcaatgcctctcagctccaggccttactaagcattgccctggagcctgccagggcccatacctccacccccagagagatcgggctcaggacctgtgagcagctgctgcagtgtttcgggcatgggcaaagcctggccttacaccacttccagcagctctggggctacctcctggagtggcaggccatatttaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccttctcgagcagatgacacgagctagtccacgttgacagcttaagacagtgctagctctgccctggctctcctagaaggtggaggacagacacaggag

SEQ ID NO: 113586 - DNA, 1046 bp, Homo sapiens
  Payload ID: 2199
  Gene Symbol: CAPN12
  Gene Name: calpain 12
  ENST ID: ENST00000594552
  CDS Start-End: 1-110
agctggggttggagcagctgtttcaggagctggctggagaggaggaagaactcaatgcctctcagctccaggccttactaagcattgccctggagcctggccatatttaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccttctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcaggagagacggcagagatatgttgctaggtgaatatatatttatataataaatccgtaagttaataaagtaaatagtaattctctgaaa

SEQ ID NO: 113587 - DNA, 546 bp, Homo sapiens
  Payload ID: 2199
  Gene Symbol: CAPN12
  Gene Name: calpain 12
  ENST ID: ENST00000598684
  CDS Start-End: 8-546
tgtccagatggcatccagcagtgggagggtcaccatccagctcgtggatgaggaggctggggtcggagccgggcgcctgcagctttttcggggccagagctatgaggcaattcgggcagcctgcctggattcggggatcctgttccgcgacccttacttccctgctggccctgatgcccttggctatgaccagctggggccggactcggagaaggccaaaggcgtgaaatggatgaggccccatgagttctgtgctgagccgaagttcatctgtgaagacatgagccgcacagacgtgtgtcaggggagcctggctgccgcctcccttactctgtatccccggctcctgcgccgggtggtccctcctggacaggatttccagcatggctacgcaggcgtcttccacttccagctctggcagtttggccgctggatggacgtcgtggtggatgacaggctgcccgtgcgtgaggggaagctgatgttcgtgcgctcggaacagcggaatgagttctgggccccactcctggagaaggcctacgccaa

SEQ ID NO: 113588 - DNA, 896 bp, Homo sapiens
  Payload ID: 2199
  Gene Symbol: CAPN12
  Gene Name: calpain 12
  ENST ID: ENST00000597987
  CDS Start-End: 1-318
gggttggagcagctgtttcaggagctggctggagaggccatatttaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccttctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcag

SEQ ID NO: 113589 - DNA, 488 bp, Homo sapiens
  Payload ID: 2199
  Gene Symbol: CAPN12
  Gene Name: calpain 12
  ENST ID: ENST00000595177
  CDS Start-End: 1-314
acctgcccctggagctggggttggagcagctgtttcaggagctggctggagaggaggaagaactcaatgcctctcagctccaggccttactaagcattgccctggagcctggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactca

SEQ ID NO: 113590 - DNA, 547 bp, Homo sapiens
  Payload ID: 2199
  Gene Symbol: CAPN12
  Gene Name: calpain 12
  ENST ID: ENST00000597740
  CDS Start-End: 8-289
tgtccagatggcatccagcagtgggagggtcaccatccagctcgtggatgaggaggctggggtcggagccgggcgcctgcagctttttcggggccagagctatgaggcaattcgggcagcctgcctggattcggggatcctgttccgcgacccttacttccctgctggccctgatgcccttggctatgaccagctggggccggactcggagaaggccaaaggcgtgaaatggatgaggccccatgctgaggcctggaatcccccaccacccacaggagttctgtgctgagccgaagttcatctgtgaagacatgagccgcacagacgtgtgtcaggggagcctgggtaactgctggttccttgcagctgccgcctcccttactctgtatccccggctcctgcgccgggtggtccctcctggacaggatttccagcatggctacgcaggcgtcttccacttccagatggaatctcactctgtcatccaggctggagtgcagtggcacaatctcggctcactgcaaccttcgccccgcccccaggttca

SEQ ID NO: 113591 - DNA, 2381 bp, Homo sapiens
  Payload ID: 2199
  Gene Symbol: CAPN12
  Gene Name: calpain 12
  ENST ID: ENST00000601953
  CDS Start-End: 248-1960
attgctgcctggaccaaggcggatgcaggaagctggggtggttcctggcctggcctgaatctgattctggtgtctggtggggacgccaggttcgccgcggggcccaggtaactgctggttccttgcagctgccgcctcccttactctgtatccccggctcctgcgccgggtggtccctcctggacaggatttccagcatggctacgcaggcgtcttccacttccagctctggcagtttggccgctggatggacgtcgtggtggatgacaggctgcccgtgcgtgaggggaagctgatgttcgtgcgctcggaacagcggaatgagttctgggccccactcctggagaaggcctacgccaagctccacggctcctatgaggtgatgcggggcggccacatgaatgaggcttttgtggatttcacaggcggcgtgggcgaggtgctctatctgagacaaaacagcatggggctgttctctgccctgcgccatgccctggccaaggagtccctcgtgggcgccactgccctgagtgatcggggtgagtaccgcacagaagagggcctggtaaagggacacgcgtattccatcacgggcacacacaaggtgttcctgggcttcaccaaggtgcggctgctgcggctgcggaacccatggggctgcgtggagtggacgggggcctggagcgacagctgcccacgctgggacacactccccaccgagtgccgcgatgccctgctggtgaaaaaggaggatggcgagttctggatggagctgcgggacttcctcctccatttcgacaccgtgcagatctgctcgctgagcccggaggtgctgggccccagcccggaggggggcggctggcacgtccacaccttccaaggccgctgggtgcgtggcttcaactccggcgggagccagcctaatgctgaaaccttctggaccaatcctcagttccgtttaacgctgctggagcctgatgaggaggatgacgaggatgaggaagggccctgggggggctggggggctgcaggggcacggggcccagcgcgggggggccgcacgcccaagtgcacggtccttctgtccctcatccagcgcaaccggcggcgcctgagagccaagggcctcacttacctcaccgttggcttccacgtgttccagattccagaggagctgctgggcctctgggattccccgcgcagccatgcgctcctgccccggctgctgcgcgccgaccgctcgcccctcagcgcccgccgcgacgtgacccgccgctgctgcctgcgtccaggccactacctggtggtgccgagcaccgcccacgccggcgacgaggctgacttcactctgcgtgtcttctccgagcgccgccacacggccgtggagatcgacgacgtgatcagcgcagacctgcagtctctccagggcccctacctgcccctggagctggggttggagcagctgtttcaggagctggctggagaggaggaagaactcaatgcctctcagctccaggccttactaagcattgccctggagcctgccagggcccatacctccacccccagagagatcgggctcaggacctgtgagcagctgctgcagtgtttcgggcatgggcaaagcctggccttacaccacttccagcagctctggggctacctcctggagtggcaggccatatttaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccttctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaa

SEQ ID NO: 113592 - DNA, 3129 bp, Homo sapiens
  Payload ID: 2199
  Gene Symbol: CAPN12
  Gene Name: Calpain 12
  ENST ID: ENST00000635148
  CDS Start-End: 310-2469
actgacctccttcttggtgctctgacagcggcagccggtcctccctcagctctgcccgccttctctcctgctgctggccaagcccattaagctgctaccttggccacaactgaaggccccacgccctgggaagaaagctactgaagaggcgtccctgctccccagcaccccaaaccatcaattaatattaacgagggaaggctcctcattgcctaaagaccccactggggctccaatggaagagaggccccgcccccgtgactcaggaggttaaagggcctggtgccggcttgtgaggccagtgtccagatggcatccagcagtgggagggtcaccatccagctcgtggatgaggaggctggggtcggagccgggcgcctgcagctttttcggggccagagctatgaggcaattcgggcagcctgcctggattcggggatcctgttccgcgacccttacttccctgctggccctgatgcccttggctatgaccagctggggccggactcggagaaggccaaaggcgtgaaatggatgaggccccatgagttctgtgctgagccgaagttcatctgtgaagacatgagccgcacagacgtgtgtcaggggagcctgggtaactgctggttccttgcagctgccgcctcccttactctgtatccccggctcctgcgccgggtggtccctcctggacaggatttccagcatggctacgcaggcgtcttccacttccagctctggcagtttggccgctggatggacgtcgtggtggatgacaggctgcccgtgcgtgaggggaagctgatgttcgtgcgctcggaacagcggaatgagttctgggccccactcctggagaaggcctacgccaagctccacggctcctatgaggtgatgcggggcggccacatgaatgaggcttttgtggatttcacaggcggcgtgggcgaggtgctctatctgagacaaaacagcatggggctgttctctgccctgcgccatgccctggccaaggagtccctcgtgggcgccactgccctgagtgatcggggtgagtaccgcacagaagagggcctggtaaagggacacgcgtattccatcacgggcacacacaaggtgttcctgggcttcaccaaggtgcggctgctgcggctgcggaacccatggggctgcgtggagtggacgggggcctggagcgacagctgcccacgctgggacacactccccaccgagtgccgcgatgccctgctggtgaaaaaggaggatggcgagttctggatggagctgcgggacttcctcctccatttcgacaccgtgcagatctgctcgctgagcccggaggtgctgggccccagcccggaggggggcggctggcacgtccacaccttccaaggccgctgggtgcgtggcttcaactccggcgggagccagcctaatgctgaaaccttctggaccaatcctcagttccgtttaacgctgctggagcctgatgaggaggatgacgaggatgaggaagggccctgggggggctggggggctgcaggggcacggggcccagcgcgggggggccgcacgcccaagtgcacggtccttctgtccctcatccagcgcaaccggcggcgcctgagagccaagggcctcacttacctcaccgttggcttccacgtgttccagattccagaggagctgctgggcctctgggattccccgcgcagccatgcgctcctgccccggctgctgcgcgccgaccgctcgcccctcagcgcccgccgcgacgtgacccgccgctgctgcctgcgtccaggccactacctggtggtgccgagcaccgcccacgccggcgacgaggctgacttcactctgcgtgtcttctccgagcgccgccacacggccgtggagatcgacgacgtgatcagcgcagacctgcagtctctccagggcccctacctgcccctggagctggggttggagcagctgtttcaggagctggctggagaggaggaagaactcaatgcctctcagctccaggccttactaagcattgccctggagcctgccagggcccatacctccacccccagagagatcgggctcaggacctgtgagcagctgctgcagtgtttcgggcatgggcaaagcctggccttacaccacttccagcagctctggggctacctcctggagtggcaggccatatttaacaagttcgatgaggacacctctggaaccatgaactcctacgagctgaggctggcactgaatgcagcaggcttccacctgaacaaccagctgacccagaccctcaccagccgctaccgggatagccgtctgcgtgtggacttcgagcggttcgtgtcctgtgtggcccacctcacctgcatcttctgccactgcagccagcacctggatgggggtgagggggtcatctgcctgacccacagacagtggatggaggtggccaccttctcctaggatctccggatgggcgcacctgctgctcagggcagggttgctgagcaagaccacctccctaggccttgcctggcatgggtgccactctctctggcatccacctgtctggggctagtctctggccctcactgctcacggccgggtgaccactctggcctgcgtactcctcactcagaaacaagaacagcgacagcccttctcgagcagatgacacgagctagtccacgttgacagcttaagacagtgctagctctgccctggctctcctagaaggtggaggacagacacaggagaaataaaaaaagatgatgctgcaggaatccttcttaaaaatattacatgttttattatcctgtccccagagggtggtttatccagaaaccaagaaaaaaaatcaatcagaataaactcaaaaaaaaaaggtagggggagcaaaaccatcaaccaccaggcagccaggccatcagcccacctccacctctggagggtccccagagacccacgcccgacgcagacccggaggagcatcagcaaggggcccgggcagagaatcggctatgtcttcattatgagagcaggagagacggcagagatatgttgctaggtgaatatatatttatataataaatccgtaagttaataaagtaaatagtaattctc

SEQ ID NO: 113593 - DNA, 2683 bp, Homo sapiens
  Payload ID: 2200
  Gene Symbol: CAPN13
  Gene Name: calpain 13
  Uniprot ID: Q6MZZ7
  ENST ID: ENST00000295055
  CDS Start-End: 178-2187
aagcagacaccagcactgctctttctccaagacggccggccatgctctcctcctctgccagtctcctccaccactctctaacctgagagcctgtggaacctgcccgtctcccctcctccatcagacacacctgcctaggaaacaggaaaggacctcggaagtcttctaaggagagtcatggcgtattaccaggagccttcagtggagacctccatcatcaagttcaaagaccaggactttaccaccttgcgggatcactgcctgagcatgggccggacgtttaaggatgagacattccctgcagcagattcttccataggccagaagctgctccaggaaaaacgcctctccaatgtgatatggaagcggccacaggatctaccagggggtcctcctcacttcatcctggatgatataagcagatttgacatccaacaaggaggcgcagctgactgctggttcctggcagcactgggatccttgactcagaacccacagtacaggcagaagatcctgatggtccaaagcttttcacaccagtatgctggcattttccgtttccggttctggcaatgtggccagtgggtggaagtggtgattgatgaccgcctacctgtccagggagataaatgcctctttgtgcgtcctcgccaccaaaaccaagagttctggccctgcctgctggagaaggcctatgccaagctgctcggatcctattccgatctgcactatggcttcctcgaggatgccctggtggacctcacaggaggcgtgatcaccaacatccatctgcactcttcccctgtggacctggtgaaggcagtgaagacagcgaccaaggcaggctccctgataacctgtgccactccaagtgggccaacagatacagcacaggcgatggagaatgggctggtgagtctccatgcctacactgtgactggggctgagcagattcaataccgaaggggctgggaagaaattatctccctgtggaacccctggggctggggcgaggccgaatggagagggcgctggagtgatgggtctcaggagtgggaggaaacctgtgatccgcggaaaagccagctacataagaaacgggaagatggcgagttttggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctggctggctcacagcggttccgggagaaatttccacccgtgtttttttcctcgttcagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaactgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcaggacaagctcccagtgatcactcaagaatctggctctcattctaagaggctgtgctgcccagtatggtggttgtgataaatctaaaccagccctgcatgaaacagagtccaagctgtctcccaacagcctgggttcggtccttggctggcccaggcccagttaagcctgtggccaccaagcagctcatctgagcactttgggatgtattcagcctacgttgccctggaaaaggaagcaggagatgtctccctgtgggaaaggagaagagaagttgtctctgagtcccctgtcaccagttggattcatttcttggaagagccagaatgagccactttgaccaccctcgggtgctatgggtgacacaagagctgtccactgggtgtttgcagaataattacactatcttatgtctggatcctgatgatttcacagctaaatggcaaaaataaaacatgtttcccataaa

SEQ ID NO: 113594 - DNA, 2328 bp, Homo sapiens
  Payload ID: 2200
  Gene Symbol: CAPN13
  Gene Name: calpain 13
  ENST ID: ENST00000450650
  CDS Start-End: 1-377
caaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcagaggctggacattgatgccacccagcttcagggccttctcaaccaggagcttctaacaggacctccaggggacatgttctccttagatgagtgccgcagcttggtggctctgatggaagtatcctttgcggtcatccctcccatgctctgagcacccctcagctctgtgggcttccccagagacctaattaggacagtagggaacccttttcccactcagtattttctcttcttccctgtccttgagtttctggggattctctactaactcactaacataccacagcaacaatgataatagttaccatctatcaagcacctactatgtgctgatcagtgtactggggtgtgtgtgtgtgtgtgtgtgtgtgtgtgtgtgtgtgtgtccttataattcttgaagcaatccctctgatacaaaaaagtatcatctcataatacagtagaagaaacaggagttcagagaggttaagtaatttgcccagatcacacagctagtcaggactcatgctcagatttgaagttggagctttcagcctccaaagtcgatgctctaaccttatcctaaaccgcccctttatagcaccgttgggaactattttcccttttacccattcacttcccactggaggagtctccattatttaaatttcttacttcaacaagtccccaattcaatcaagataactaccaccaaaacatggaaaactgcctggtctacacagcagttgcaccccagcattgctatgctgcattcacagcgggagacgctgggcagaggcagttcagagactcactccaggcccgtggctacaagtgtaggaccaagaattgaaccccagactcctgaccctcctcctgatttccattccccagtgagccatcctcttcctgcgtacccctggcttggcaagcagaagaggctgactccatgagtgtagacccccagatgctgccctgccagcccctcactcggcagtgtgctgtctcctgagacgcattgccccgctcctgcaccgttgacaaggctgaattgggactgtgaagccggccattgtgaaacaagagggcttttttgatgaaatcataaatcaggccctgtctctgctggctgtgctttggaatctatcagagacacagcccatctcccacagaggaatccaaatggtcctcacagtgccacggcccggggatggcagcccctctgcaccttgcacgctggctggttcactcttaactccttacccagctgaaagtgaatgggcggctagaccaagaggagtttgcgcgactgtggaagcgccttgttcactaccagcatgttttccagaaggttcagacaagccctggagtcctcctgagctcggacttgtggaaggccatagagaatacagacttcctcagagggatcttcatcagccgtgagctgctgcatctggtgaccctcaggtacagcgacagcgtcggcagggtcagcttccccagcctggtctgcttcctgatgcggcttgaagccatggcaaagaccttccgcaacctctctaaggatggaaaaggactctacctgacagaaatggagtggatgagcctggtcatgtacaactgaagcaaagaggaaagcagacccatggctcaggacaagctcccagtgatcactcaagaatctggctctcattctaagaggctgtgctgcccagtatggtggttgtgataaatctaaaccagccctgcatgaaacagagtccaagctgtctcccaacagcctgggttcggtccttggctggcccaggcccagttaagcctgtggccaccaagcagctcatctgagcactttgggatgtattcagcctacgttgccctggaaaaggaagcaggagatgtctccctgtgggaaaggagaagagaagttgtctctgagtcccctgtcaccagttggattcatttcttggaagagccagaatgagccactttgaccaccctcgggtgctatgggtgacacaagagctgtccactgggtgtttgcagaataattacactatcttatgtctggatcctgatgatttcacagctaaatggcaaaaataaaacatgtttcccataaa

SEQ ID NO: 113595 - DNA, 2269 bp, Homo sapiens
  Payload ID: 2200
  Gene Symbol: CAPN13
  Gene Name: calpain 13
  Uniprot ID: Q6MZZ7
  ENST ID: ENST00000458085
  CDS Start-End: 244-1515
ctttctccaagacggccggccatgctctcctcctctgccagtctcctccaccactctctaacctgagagcctgtggaacctgcccgtctcccctcctccatcagacacacctgcctaggaaacagatggaaaaagtgagggaccggtgagtgacttgctgcaaaagtttataccagatgcaaatgacagagctggagttctgctgtgcctggaaaggacctcggaagtcttctaaggagagtcatggcgtattaccaggagccttcagtggagacctccatcatcaagttcaaagaccaggactttaccaccttgcgggatcactgcctgagcatgggccggacgtttaaggatgagacattccctgcagcagattcttccataggccagaagctgctccaggaaaaacgcctctccaatgtgatatggaagcggccacaggatctaccagggggtcctcctcacttcatcctggatgatataagcagatttgacatccaacaaggaggcgcagctgactgctggttcctggcagcactgggatccttgactcagaacccacagtacaggcagaagatcctgatggtccaaagcttttcacaccagtatgctggcattttccgtttccggttctggcaatgtggccagtgggtggaagtggtgattgatgaccgcctacctgtccagggagataaatgcctctttgtgcgtcctcgccaccaaaaccaagagttctggccctgcctgctggagaaggcctatgccaagctgctcggatcctattccgatctgcactatggcttcctcgaggatgccctggtggacctcacaggaggcgtgatcaccaacatccatctgcactcttcccctgtggacctggtgaaggcagtgaagacagcgaccaaggcaggctccctgataacctgtgccactccaagtgggccaacagatacagcacaggcgatggagaatgggctggtgagtctccatgcctacactgtgactggggctgagcagattcaataccgaaggggctgggaagaaattatctccctgtggaacccctggggctggggcgaggccgaatggagagggcgctggagtgatgggtctcaggagtgggaggaaacctgtgatccgcggaaaagccagctacataagaaacgggaagatggcgagttttggatgtcgtgtcaagatttccaacagaaattcatcgccatgtttatatgtagcgaaattccaattaccctggaccatggaaacacactccacgaaggatggtcccaaataatgtttaggaagcaagtgattctaggaaacactgcaggaggacctcggaatgatgctcaattcaacttctctgtgcaagagccaatggaaggcaccaatgttgtcgtgtgcgtcacagttgctgtcacaccatcaaatttgaaagcagaagatgcaaaatttccactcgatttccaagtgattctggctggctcacagaaacactgtccaaagctcaaataataaattccgccgcaacttcaccatgacttaccatctgagccctgggaactatgttgtggttgcacagacacggagaaaatcagcggagttcttgctccgaatcttcctgaaaatgccagacagtgacaggcacctgagcagccatttcaacctcagaatgaagggaagcccttcagaacatggctcccaacaaagcattttcaacagatatgctcagcaggtatggtacctagcacccaggggccttacgtgggattggagaaaggggacctgagggagggacagctctcacaggcccttactgggatgcagagaggagaagtgacttgatggactattttacctgcctctcttcctggatcgtctccagaactgctgtggctgccaagctcggtagagacgtggcgccccacccagtgtcatccgggggacttcaagctggaatgcagagcttagaaagggaggggataattatggggtgtgaggtgcattgccctctaaatctttaaacaagcaattggcagtaccccgtgaaacctttccttctcctactcggccacctcccaccaacctggcatcgttcctcccgggagctagccagcttcagaaagcacatacagcatccttgctgccaaaccacctatgtgcacacaggatttccttaatggcttaataaactgttataaagaactccttgacttgtcagaataaaatagctgccaggggctctgcacaatgagcctcttaccgttaa

SEQ ID NO: 113596 - DNA, 710 bp, Homo sapiens
  Payload ID: 2200
  Gene Symbol: CAPN13
  Gene Name: calpain 13
  ENST ID: ENST00000485248
  CDS Start-End: 244-552
ctttctccaagacggccggccatgctctcctcctctgccagtctcctccaccactctctaacctgagagcctgtggaacctgcccgtctcccctcctccatcagacacacctgcctaggaaacagatggaaaaagtgagggaccggtgagtgacttgctgcaaaagtttataccagatgcaaatgacagagctggagttctgctgtgcctggaaaggacctcggaagtcttctaaggagagtcatggcgtattaccaggagccttcagtggagacctccatcatcaagttcaaagaccaggactttaccaccttgcgggatcactgcctgagcatgggccggacgtttaaggatgagacattccctgcagcagattcttccataggccagaagctgctccaggaaaaacgcctctccaatgtgatatggaagcggccacaggatctaccagggggtcctcctcacttcatcctggatgatataagcagatttgacatccaacaaggaggcgcagttctggcaatgtggccagtgggtggaagtggtgattgatgaccgcctacctgtccagggagataaatgcctctttgtgcgtcctcgccaccaaaaccaagagttctggccctgcctgctggagaaggcctatgccaagctgctcggatcctattccgatctgcactatggcttcctcgaggatgccctggtggacc

SEQ ID NO: 113597 - DNA, 3787 bp, Homo sapiens
  Payload ID: 2201
  Gene Symbol: CAPN14
  Gene Name: calpain 14
  ENST ID: ENST00000398824
  CDS Start-End: 245-676
attcatcacactccctgctttgaatcgcctctccttcagttgctgaggtcaattccctaggaaaacagcaggatcttgattgcaccatcccactcaacagcctcgcttgggtaagggaaacaccaaaagcagaaaaatccatgctgaaggaccccaggaccagcaccagttcctgagcatctttcccgggctgagcagcagagactcctcaggaagactcactggactgtacccaccacctgccatgtctctgtggccacctttccgatgcagatggaagctggcgccaaggtactctaggagggcgtctccacagcaaccccaacaggactttgaggccctgctggcagagtgcctgaggaatggctgcctctttgaagacaccagcttcccggccaccctgagctccatcggcagtggctccctgctgcagaagctgccaccccgcctgcagtggaagaggcccccggagctgcacagcaatccccagttttattttgccaaggccaaaaggctggatctgtgccaggggatagtaggagactgctggttcttggctgctttgcaagctctggccttgcaccaggacatcctgagccgggttgttcccctgaatcagagtttcactgagaagtatgctggcatcttccggttctgggctctctggttcctatgaagacttgcagtcaggacaggtgtctgaagcccttgtagacttcactggaggggtgacaatgaccatcaacctggcagaagcccatggcaacctctgggacatcctcatcgaagccacctacaacagaaccctcattggctgccagacccactcaggggagaagattctggagaatgggctggtggaaggccatgcctatactctcacaggaatcaggaaggtgacctgcaaacatagacctgaatatctcgtcaagctacggaacccctggggaaaggtggaatggaaaggagactggagtgacagttcaagtaaatgggagctgctgagccccaaggagaagattctgcttctgaggaaagacaatgacggagaattctggatgacgctgcaggactttaaaacacatttcgtgctcctggttatctgtaaactgaccccaggcctgttgagccaggaggcggcccagaagtggacgtacaccatgcgggaggggagatgggagaagcggagcacagctggtggccagaggcagttgctgcaggacacattttggaagaacccgcagttcctgctgtctgtctggaggcccgaggagggcaggagatccctgaggccctgcagcgtgctggtgtccctgctccagaagcccaggcacaggtgccgcaagcggaagcctctcctcgccattggcttctacctgtataggatgaacaagtaccatgatgaccagaggagactgccccctgagttcttccagagaaacactcctctgagccagcctgataggtttctcaaggagaaagaagtgagtcaggagctgtgtctggaaccagggacgtacctcatcgtgccctgcatattggaggcccaccagaagtcagagttcgtcctcagggtcttctccaggaagcacatcttttatgaaattggcagcaattctggtgtcgtcttctcaaaggagatagaagaccaaaatgaaaggcaggatgaattcttcaccaaattctttgaaaagcatccagagattaatgcagttcaacttcagaacctcctgaaccagatgacctggtcaagtctggggagcagacagcccttctttagcctggaagcctgccaggggatcctggccttactggaccttaatgcatcaggtactatgagcatccaggaattcagggacctgtggaagcagctgaagctctctcagaaggttttccacaagcaagaccgtgggtcaggatacctgaactgggagcagctgcacgctgccatgagggaggcaggaatcatgctcagtgatgacgtctgtcagctgatgctcatccgctacggcggcccccgcctccagatggactttgtcagtttcatccacttgatgctgcgtgtagagaacatggaggatgtcttccaaaacttaacccaagatggcaaagggatatacctccagaagccagagtggatgatgatggcactgtactcctgagaaggctgagtctcacctgccctcactgaagactctgcatgtggcccaagagcagcctttggctgagaccaacccatgcccaccctacttactgatcttcaggacagcctcactagccgtcaccttctcagctgggaaggtttctcttctgcagccctccccgtgcatggccagcatgcagaaagggaagggaggaagtaaagattacatcagatttgtaaaagctagccatccttccctgaggccacaaccttgtcacaagcggagatgttacctgacatggcctaagcattctgactccagagctggtgtggttagcctccatacaacactgcctctgtggctgcaaactcaagtgactttagacatgccacatgttctcacatggtggggtaatcatctaggttttaaggtctgaaatgggaatgatatatccttagacatttagtcccagcatctgcaaattgatagagacataggctaagtttcagctgtttggggatggggtcagggatatagtgggctttcagaaacacagacagtaagagaattggcagagtccaggtggggtgggctggctctggcatctgaggtcatggggtagtcttcttctgacaatatctccgtatgattggatctggggcaacctagtagatttaaaacacctgagttctcaaagggcttcctgcttgtgacaggtgtgtctatttgcttgatatatagactatcagatccatttcaaatctgtccagaaattctctgtctatctacttcaaaggacaaaaacaaacccatgctaaattatagagtcaatcagtgggtggttggtatatctgattttttgaactaccatgaaacaccttgtttatgtcatccctctcaaccaagaatacaggtgcaaaaccagaacaatggcctttttccaaagtctatgcaatttattcataagttagcacctcagagccatttattactacaggttgagcatcccaaatctgaaaaccccaaatctgaaatactccaaaatctaaaatttctgagagtagacatgaaactcaaaggaaataggggcattttggattttgaatttttgggtttgaggtgttcaactgacaagtctataatgcagatatcctgaaatctgaaacacttctggtcccaagcattttagttaagagatagtcaacctgtattctatttaatcttaatttacaaacaattctaacaaacatggctgtttgatttccaactccatagcagactcaggaaggaagctgaatgaagagataaaagtgtgtccattggcagaggactaaaggagatttgagcacctgtcagatgggtactgtaccagaagaaaggagcactttgaaagcgtagcttatggggtaggaaagtattttatttaggaaaaaaaacccttcatttattccaaatgataaaatgtaaaatgggtttccataaagtgccagatacatgagatgttgttgattttataaatgatgatcatgtatttacagccttttacagttttttatatccattgacttatttgtgtctttgtctttaaaatctgccattgcaaatagctgttttaataaaccaattttgccttggcccctgaa

SEQ ID NO: 113598 - DNA, 2197 bp, Homo sapiens
  Payload ID: 2201
  Gene Symbol: CAPN14
  Gene Name: calpain 14
  Uniprot ID: A8MX76
  ENST ID: ENST00000403897
  CDS Start-End: 143-2197
atataagaggtggtttcaggctgcatgcttctgactgcaccgggattagagcttgcccaggcgcttaaagaagcaaaatctcctgtgcaggagcagcagagactcctcaggaagactcactggactgtacccaccacctgccatgtctctgtggccacctttccgatgcagatggaagctggcgccaaggtactctaggagggcgtctccacagcaaccccaacaggactttgaggccctgctggcagagtgcctgaggaatggctgcctctttgaagacaccagcttcccggccaccctgagctccatcggcagtggctccctgctgcagaagctgccaccccgcctgcagtggaagaggcccccggagctgcacagcaatccccagttttattttgccaaggccaaaaggctggatctgtgccaggggatagtaggagactgctggttcttggctgctttgcaagctctggccttgcaccaggacatcctgagccgggttgttcccctgaatcagagtttcactgagaagtatgctggcatcttccggttctggttctggcactatgggaactgggttcctgtggtgatcgatgaccgtctgcctgtgaatgaggctggccagctggtctttgtctcctccacctataagaacttgttctggggagcacttctggaaaaggcctatgccaagctctctggttcctatgaagacttgcagtcaggacaggtgtctgaagcccttgtagacttcactggaggggtgacaatgaccatcaacctggcagaagcccatggcaacctctgggacatcctcatcgaagccacctacaacagaaccctcattggctgccagacccactcaggggagaagattctggagaatgggctggtggaaggccatgcctatactctcacaggaatcaggaaggtgacctgcaaacatagacctgaatatctcgtcaagctacggaacccctggggaaaggtggaatggaaaggagactggagtgacagttcaagtaaatgggagctgctgagccccaaggagaagattctgcttctgaggaaagacaatgacggagaattctggatgacgctgcaggactttaaaacacatttcgtgctcctggttatctgtaaactgaccccaggcctgttgagccaggaggcggcccagaagtggacgtacaccatgcgggaggggagatgggagaagcggagcacagctggtggccagaggcagttgctgcaggacacattttggaagaacccgcagttcctgctgtctgtctggaggcccgaggagggcaggagatccctgaggccctgcagcgtgctggtgtccctgctccagaagcccaggcacaggtgccgcaagcggaagcctctcctcgccattggcttctacctgtataggatgaacaagtaccatgatgaccagaggagactgccccctgagttcttccagagaaacactcctctgagccagcctgataggtttctcaaggagaaagaagtgagtcaggagctgtgtctggaaccagggacgtacctcatcgtgccctgcatattggaggcccaccagaagtcagagttcgtcctcagggtcttctccaggaagcacatcttttatgaaattggcagcaattctggtgtcgtcttctcaaaggagatagaagaccaaaatgaaaggcaggatgaattcttcaccaaattctttgaaaagcatccagagattaatgcagttcaacttcagaacctcctgaaccagatgacctggtcaagtctggggagcagacagcccttctttagcctggaagcctgccaggggatcctggccttactggaccttaatgcatcaggtactatgagcatccaggaattcagggacctgtggaagcagctgaagctctctcagaaggttttccacaagcaagaccgtgggtcaggatacctgaactgggagcagctgcacgctgccatgagggaggcaggaatcatgctcagtgatgacgtctgtcagctgatgctcatccgctacggcggcccccgcctccagatggactttgtcagtttcatccacttgatgctgcgtgtagagaacatggaggatgtcttccaaaacttaacccaagatggcaaagggatatacctccagaagccagagtggatgatgatggcactgtactcctga

SEQ ID NO: 113599 - DNA, 4744 bp, Homo sapiens
  Payload ID: 2202
  Gene Symbol: CAPN15
  Gene Name: calpain 15
  Uniprot ID: O75808
  ENST ID: ENST00000219611
  CDS Start-End: 364-3624
gccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagacagggagccaggatgggaaccacggactgacctgacctgcgtcctcggggccactgcactgggtgattcacgtgtgcccaggccctgaggtgggccggacctgggagtggcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtcccggaagtggtggccccggccggcttccacgtcgtgcctgccgcgcctccacctggcctccccggggaaggtgccgaggccaaccccccagccaccagccagggcccagctgccgaaccagagccgcccagggtcccgcccttcagccccttctcgtccaccctgcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatgcacgtggagcagcggcggcagacagacgagggcgaggccaaggcactctgggagaacatcgtggccttctgccgggagaacaatgtgagcttcgtggatgacagcttccctcccgggcccgagtctgtcggcttccccgcgggtgacagcgtgcagcagcgtgtgaggcagtggctgcgaccccaggagatcaactgctccgtcttcagggaccacagggccacgtggtctgtgttccacacactgcggccctcagacatcctgcaggggctgctggggaactgctggttcctgagcgccctggcggtgctggcggagcggccggacctggtggagcgggtgatggtcacgcgcagcctgtgtgcagagggcgcctaccaggtgcggctgtgcaaggacggcacgtggaccacggtgctggtggacgacatgctgccctgtgatgaggccggctgcctcctcttctcacaggcgcagcggaagcagctgtgggtggccctcatcgagaaggcgctggccaagctgcacggctcctactttgcgctccaggcgggccgcgccatcgaaggcctggccacgctcaccggcgccccctgtgagagcctggcgctgcagctcagctccactaacccccgcgaggagcccgttgacactgacctcatctgggccaaaatgctgagttctaaggaggctgggttcctcatgggtgcctcctgtggcgggggcaacatgaaggtggacgattcggcctacgagagcctgggcctgcgcccccggcatgcctactccatcctggatgtccgagatgtccagggcaccaggcttctgcggctccgaaacccgtggggccgtttctcctggaacggcagctggtccgacgagtggccacactggccggggcacctgcgtggcgagctcatgccgcacggcagcagtgagggtgtcttctggatggagtacggcgactttgtcaggtacttcgactccgtggacatctgtaaggtgcactcggactggcaggaggcgcgggtgcagggctgctttcccagctcggccagcgcgcccgtgggggtaacagcgctcacggtgctggagcgggcctcgctggagttcgcgctcttccaggagggcagcaggcgctcggacgccgtggacagccacctgctggacctgtgcatcctggtgttccgggccacgttcggcagcggcggccacctcagcctgggccgcctcctggcccacagtaagcgcgcggtcaagaagttcgtcagctgcgacgtcatgctggagcctggcgagtacgctgtggtgtgctgcgccttcaaccactgggggccgcccctgccgggcacccctgccccccaggcctccagcccctcggcaggggtcccgagagcctccccagagccgccgggccacgtgctggctgtgtacagctcgaggctggtcatggtggagcccgtggaagcccagccgaccacgctggccgacgccatcatcctgctcaccgagagccgcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacaggcaggtcctggtgatcttgtcccagctagagggcaacgccggcttctctatcacccaccgcctggcacatcgcaaggcagcccaggccttcctcagtgactggacagcctccaaggggacccacagccccccactcacgccagaggtcgccggtctgcatgggccccgaccgctgtgaccaccatgcctggggcaggggctgtgcacagacggaccccccacccccacacgcactttatgagggagaccccgacagaggacgcttgagccagaatctcaggaccccgcccagggagctgccagcccagggctcagcttcccatgggccccccgcccccctccttcccctccctgaaccccacagtccgcctggccaggcctcctggccgccacgcagaatacctcgaaccaggcgggctgtgaaccagccccgctcacctgccagccccaacacccgacgggggccgaggccaggctgcccctccctgtgggctcagggtctcctgcgggctaggcagccaggagctctgtccgcaaaaccaaatctgggtgtcagaggccaagaccctggggtgggatcagggaccacccctcacggggcataaggtcagttttcccccagagcccgggtccctgtcccccacagggcaggcggggtccctggagccctggtgtggagcggcgagtcccggggcggtgcctgtctcagaagaaggggcccttggccagccccccagcgacactatgcaaatcctggagtgcccgccaggatcgaagccatgactgggtgcaggcgggcgccaggcccgctgtgggtgggcaccagttctcagcaccgctcactgctgccgggcacactgggaccagcaggctcctcagccaaccctgtccctcggcccggccctgccagagagggaccccagcacatcgtgggcacgggcagggctcagccgctcccacctccccacagaagcccaggagtgtgtggacgtctgagcccagctttctgcgtgccctcctggcccctcactcccggcagcgggccggcctcgcccccactccccctcctaccccggcaggggcttccggggccttttcacctggagaaacattcccactcccctttggcctccctgtactctgagctgtgaatatttttaaccctgtaaatacggccagctcttgtgacacagagactattttatcaattgtcagtcccgttcctttaccataggattctccacagtggcttccgactcaggctccaatggaccaaataaaagcgttttgttttgtaa

SEQ ID NO: 113600 - DNA, 942 bp, Homo sapiens
  Payload ID: 2202
  Gene Symbol: CAPN15
  Gene Name: calpain 15
  ENST ID: ENST00000562370
  CDS Start-End: 389-942
ccgggcgcgcgattcacagcgccgcgtgcgccccgggcgcgccgtagccgcggggcccgggccgggcgctacgctacgaaggcagcgtaaggcgggcgccggacgcgggcaggggccggggccggagccgggtcggggcgccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagccacacccactcgcccgggtctatggccacggtcggagagtggtcctgtgtgcgctgcaccttcctgaacccggccggccagcgccagtgctccatctgcgaggctccccggcacaagcccgacctcaaccacatcctgcggctcagcgtggaggagcagaaatggccctgcgcccgctgcaccttccgcaacttcctgggcaaggaggcctgcgaggtgtgcggcttcaccccggagcctgcgcctggggctgccttcctgccagtcctcaacggggtcctccccaagccacccgccatcctgggggagcccaagggcagctgccaggaggaagcaggtccagtgaggactgcggggctggtggccacggagcccgccagggggcagtgcgaggacaaggacgaggaggagaaggaggagcaggaggaggaggagggagcggcggagcccagagggggctgggcgtgtccgcgttgcacgctgcacaacacgcccgtggccagctcctgctccgtctgcgggggcccacgcaggctctcgctgccacggatccctcctgaggccctggtggtccc

SEQ ID NO: 113601 - DNA, 911 bp, Homo sapiens
  Payload ID: 2202
  Gene Symbol: CAPN15
  Gene Name: calpain 15
  ENST ID: ENST00000568988
  CDS Start-End: 575-911
gggcaggggccggggccggagccgggtcggggcgccccgcggctgaggagcgggaggccgtccgggcagcgcggccggcggcgagaggggccccgccgctctccggaggcagaagttgtggatcggccggcgggggcgagcgggcccgggggccggggccgcgctgcccgggccgcgaggacgaggcggcgccgccgggctgtggaggcagcagcccagacgcggcacagagagggcctgggagcttgctgcagcttcagaacaaccccgtgccgcgcagccgacgcgaggttcccccccagctgcagccaccggtgcctgaggctgcccagccgtcaccctctgccggctgcaggggagccccccagggctcgggctgggctggggcctcccgcctagcagagttgctgtctggcaagcggctgagtgtgctggaggaagaggccacggagggtggcaccagccgcgtagaggccggcagctccacctcgggcagtgacatcattgacctggccggagacaccgtgcgttacacgcccgccagcccctccagccccgacttcaccacctggtcatgtgccaagtgcacgctcagaaaccccacagtggcccccaggtgctcggcctgcggctgctccaaactgcacggcttccaggagcatggcgagccccccacccactgccccgactgtggggccgacaagcccagcccctgcggcagaagctgcggacgggtgtcctcggcccagaaggccgcccgcgtcctgcccgagcgcccgggccagtgggcctgccctgcctgtaccctgctcaacgcactgcgggccaagcactgcgccgcctgccacacgcctcagctcctggtggcccagcggcggggggccgcgcccctgaggcgcagggagagcatg

SEQ ID NO: 113602 - DNA, 279 bp, Homo sapiens
  Payload ID: 2202
  Gene Symbol: CAPN15
  Gene Name: calpain 15
  ENST ID: ENST00000566977
  CDS Start-End: 1-215
gcggagagcggcacgagggccgtgagggcatgacctgctactacctgacacacggttgggcggggctcatcgtggtggtggagaaccgacaccccaaggcctacctgcacgtgcagtgtgactgcaccgacagcttcaacgtggtgtccacacgcggcagcctgcgtacccaggatagcgtgccacccctgcacagtcccgttcctttaccataggattctccacagtggcttccgactcaggctccaatggaccaaataaaagcgttttgttttgtaa

SEQ ID NO: 113603 - DNA, 3573 bp, Homo sapiens
  Payload ID: 2203
  Gene Symbol: CAPN2
  Gene Name: calpain 2, (m/II) large subunit
  Uniprot ID: P17655
  ENST ID: ENST00000295006
  CDS Start-End: 310-2412
cctccccggcgccgggccgcgccatcccgggagctgtccgcagatggcagcaccggccccgggtcgcggcgttcccggcgctcggcaggccgcaggatggcctggtcccgggccgggagcccagcaggccgggagcggctgaggccacaccccgcgggccgggccgcttccctccggtgaatcatcgctcgcagcggcggcgcccgcagtggccgcagcagcgcgccgggccctggccgcgccccagccgagcgcagcgcggagtcgccccgacctttctctgcgcagtacggccgccgggaccgcagcatggcgggcatcgcggccaagctggcgaaggaccgggaggcggccgaggggctgggctcccacgacagggccatcaagtacctcaaccaggactacgaggcgctgcggaacgagtgcctggaggccgggacgctcttccaggacccgtccttcccggccatcccctcggccctgggcttcaaggagttggggccctactccagcaaaacccggggcatcgagtggaagcgccccacggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatccaa

SEQ ID NO: 113604 - DNA, 577 bp, Homo sapiens
  Payload ID: 2203
  Gene Symbol: CAPN2
  Gene Name: calpain 2, (m/II) large subunit
  ENST ID: ENST00000434648
  CDS Start-End: 185-577
caaaggaacgaatttccaggatgttcgactatgtggagaaaacaaaaaaaaagcaaagaaaaaaatatttttaaagaaagaaagaaggccaggtgcagtggttcacgcctgtaatcccaacactttgggaggccgaggcagacagatcacctgaggtcaggagttcaagaccagcctggccaacatggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccgga

SEQ ID NO: 113605 - DNA, 3264 bp, Homo sapiens
  Payload ID: 2203
  Gene Symbol: CAPN2
  Gene Name: calpain 2, (m/II) large subunit
  Uniprot ID: P17655
  ENST ID: ENST00000433674
  CDS Start-End: 237-2105
actcagactctgatggctctgtagctaactggcccatcctcagagactaacgcaaaggaacgaatttccaggatgttcgactatgtggagaaaacaaaaaaaaagcaaagaaaaaaatatttttaaagaaagaaagaaggccaggtgcagtggttcacgcctgtaatcccaacactttgggaggccgaggcagacagatcacctgaggtcaggagttcaagaccagcctggccaacatggagatctgcgctgacccccagtttatcattggaggagccacccgcacagacatctgccaaggagccctgggtgactgctggctgctggcagccattgcctccctcaccttgaatgaagaaatcctggctcgagtcgtccccctaaaccagagcttccaggaaaactatgcagggatctttcacttccagttctggcaatacggcgagtgggtggaggtggtggtggatgacaggctgcccaccaaggacggggagctgctctttgtgcattcagccgaagggagcgagttctggagcgccctgctggagaaggcatacgccaagatcaacggatgctatgaagcgctatcagggggtgccaccactgagggcttcgaagacttcaccggaggcattgctgagtggtatgagttgaagaagccccctcccaacctgttcaagatcatccagaaagctctgcaaaaaggctctctccttggctgctccatcgacatcaccagcgccgcggactcggaggccatcacgtttcagaagctggtgaaggggcacgcgtactcggtcaccggagccgaggaggttgaaagtaacggaagcctacagaaactgatccgcatccgaaatccctggggagaagtggagtggacagggcggtggaatgacaactgcccaagctggaacactatagacccagaggagagggaaaggctgaccagacggcatgaagatggagaattctggatgtctttcagtgacttcctgaggcactattcccgcctggagatctgtaacctgaccccagacactctcaccagcgatacctacaagaagtggaaactcaccaaaatggatgggaactggaggcggggctccaccgcgggaggttgcaggaactacccgaacacattctggatgaaccctcagtacctgatcaagctggaggaggaggatgaggacgaggaggatggggagagcggctgcaccttcctggtggggctcattcagaagcaccgacggcggcagaggaagatgggcgaggacatgcacaccatcggctttggcatctatgaggttccagaggagttaagtgggcagaccaacatccacctcagcaaaaacttcttcctgacgaatcgcgccagggagcgctcagacaccttcatcaacctccgggaggtgctcaaccgcttcaagctgccgccaggagagtacattctcgtgccttccaccttcgaacccaacaaggatggggatttctgcatccgggtcttttctgaaaagaaagctgactaccaagctgtcgatgatgaaatcgaggccaatcttgaagagttcgacatcagcgaggatgacattgatgatggattcaggagactgtttgcccagttggcaggagaggatgcggagatctctgcctttgagctgcagaccatcctgagaagggttctagcaaagcgccaagatatcaagtcagatggcttcagcatcgagacatgcaaaattatggttgacatgctagattcggacgggagtggcaagctggggctgaaggagttctacattctctggacgaagattcaaaaataccaaaaaatttaccgagaaatcgacgttgacaggtctggtaccatgaattcctatgaaatgcggaaggcattagaagaagcaggtttcaagatgccctgtcaactccaccaagtcatcgttgctcggtttgcagatgaccagctcatcatcgattttgataattttgttcggtgtttggttcggctggaaacgctattcaagatatttaagcagctggatcccgagaatactggaacaatagagctcgaccttatctcttggctctgtttctcagtactttgaagttataactaatctgcctgaagacttctcatgatggaaaatcagccaaggactaagcttccatagaaatacactttgtatctggacctcaaaattatgggaacatttacttaaacggatgatcatagctgaaaataatgatactgtcaatttgagatagcagaagtttcacacatcaaagtaaaagatttgcatatcattatactaaatgcaaatgagtcgcttaacccttgacaaggtcaaagaaagctttaaatctgtaaatagtatacactttttacttttacacactttcctgttcatagcaatattaaatcaggaaaaaaaaatgcagggaggtatttaacagctgagcaaaaacattgagtcgctctcaaaggacacgaggcccttggcagggaatatttaaagcaacttcaagtttaaaatgcagctgttgattctaccaaacaacagtccaagattaccatttcccatgagccaactgggaaacatggtatatcatgaagtaatcttgtcaaggcatctggagagtccaggagagaagactcacctctgtcgcttgggttaaacaagagacaggttttgtagaatattgattggtaatagtaaatcgttctccttacaatcaagttcttgaccctattcggccttatacatctggtcttacaaagaccaaagggatcctgcgcttgatcaactgaaccagtatgccaaaaccaggcatccaatttgtaaaccaattatgataaaggacaaaataagctgtttgccacctcaaaactttatgaacttcaccaccactagtgtctgtccatggagttagaggggacatcacttagaagttcttatagaaaggacacaagtttgtttcctggctttaccttgggaaaatgctagcaacattatagaaattttgccttgttgccttatcttcttccaaatgtactgttaaataaaaataaagggttaccccatgcaatcacaccatgccatgttttccttcctggagggcagccccacaggacggtttatgagcacacaattatagcttgtttctactttaacaaggtatgctgcctctgtaaattcatgtattcaaaggaaaagacaccttgcctataattaaaatgtggaactataaaattttttaaaatcc

SEQ ID NO: 113606 - DNA, 2955 bp, Homo sapiens
  Payload ID: 2204
  Gene Symbol: CAPN3
  Gene Name: calpain 3
  Uniprot ID: P20807
  ENST ID: ENST00000349748
  CDS Start-End: 222-2411
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 113607 - DNA, 3172 bp, Homo sapiens
  Payload ID: 2204
  Gene Symbol: CAPN3
  Gene Name: calpain 3
  ENST ID: ENST00000318023
  CDS Start-End: 307-2628
cactctctttctctctccctctggcatgcatgctgctggtaggagacccccaagtcaacattgcttcagaaatcctttagcactcatttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 113608 - DNA, 1271 bp, Homo sapiens
  Payload ID: 2204
  Gene Symbol: CAPN3
  Gene Name: calpain 3
  Uniprot ID: P20807
  ENST ID: ENST00000337571
  CDS Start-End: 259-729
cataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctgg

SEQ ID NO: 113609 - DNA, 1291 bp, Homo sapiens
  Payload ID: 2204
  Gene Symbol: CAPN3
  Gene Name: calpain 3
  Uniprot ID: P20807
  ENST ID: ENST00000356316
  CDS Start-End: 277-747
cataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacgtgagtagacctccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 113610 - DNA, 2669 bp, Homo sapiens
  Payload ID: 2204
  Gene Symbol: CAPN3
  Gene Name: calpain 3
  Uniprot ID: P20807
  ENST ID: ENST00000357568
  CDS Start-End: 222-2669
atttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctga

SEQ ID NO: 113611 - DNA, 3228 bp, Homo sapiens
  Payload ID: 2204
  Gene Symbol: CAPN3
  Gene Name: calpain 3
  Uniprot ID: P20807
  ENST ID: ENST00000397163
  CDS Start-End: 220-2685
ttctcaggagaacttatggcttcagaatcacagctcggtttttaagatggacataacctgtacgaccttctgatgggctttcaactttgaactggatgtggacacttttctctcagatgacagaattactccaacttcccctttgcagttgcttcctttccttgaaggtagctgtatcttattttctttaaaaagctttttcttccaaagccacttgccatgccgaccgtcattagcgcatctgtggctccaaggacagcggctgagccccggtccccagggccagttcctcacccggcccagagcaaggccactgaggctgggggtggaaacccaagtggcatctattcagccatcatcagccgcaattttcctattatcggagtgaaagagaagacattcgagcaacttcacaagaaatgtctagaaaagaaagttctttatgtggaccctgagttcccaccggatgagacctctctcttttatagccagaagttccccatccagttcgtctggaagagacctccggaaatttgcgagaatccccgatttatcattgatggagccaacagaactgacatctgtcaaggagagctaggggactgctggtttctcgcagccattgcctgcctgaccctgaaccagcaccttcttttccgagtcataccccatgatcaaagtttcatcgaaaactacgcagggatcttccacttccagttctggcgctatggagagtgggtggacgtggttatagatgactgcctgccaacgtacaacaatcaactggttttcaccaagtccaaccaccgcaatgagttctggagtgctctgctggagaaggcttatgctaagctccatggttcctacgaagctctgaaaggtgggaacaccacagaggccatggaggacttcacaggaggggtggcagagttttttgagatcagggatgctcctagtgacatgtacaagatcatgaagaaagccatcgagagaggctccctcatgggctgctccattgatgatggcacgaacatgacctatggaacctctccttctggtctgaacatgggggagttgattgcacggatggtaaggaatatggataactcactgctccaggactcagacctcgaccccagaggctcagatgaaagaccgacccggacaatcattccggttcagtatgagacaagaatggcctgcgggctggtcagaggtcacgcctactctgtcacggggctggatgaggtcccgttcaaaggtgagaaagtgaagctggtgcggctgcggaatccgtggggccaggtggagtggaacggttcttggagtgatagatggaaggactggagctttgtggacaaagatgagaaggcccgtctgcagcaccaggtcactgaggatggagagttctggatgtcctatgaggatttcatctaccatttcacaaagttggagatctgcaacctcacggccgatgctctgcagtctgacaagcttcagacctggacagtgtctgtgaacgagggccgctgggtacggggttgctctgccggaggctgccgcaacttcccagatactttctggaccaaccctcagtaccgtctgaagctcctggaggaggacgatgaccctgatgactcggaggtgatttgcagcttcctggtggccctgatgcagaagaaccggcggaaggaccggaagctaggggccagtctcttcaccattggcttcgccatctacgaggttcccaaagagatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggt

SEQ ID NO: 113612 - DNA, 1643 bp, Homo sapiens
  Payload ID: 2204
  Gene Symbol: CAPN3
  Gene Name: calpain 3
  Uniprot ID: P20807
  ENST ID: ENST00000397200
  CDS Start-End: 170-1099
ccctcctccacgcttacagccacacacacagtcacacagacgcgttctgagggtggctgcccgcttgggatggaggaatcacttccctcagaacccagccaagtcctctaggcctccttgggggtccttccagcctgaggggcttcggagctgaggagcagctgttctgatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 113613 - DNA, 1237 bp, Homo sapiens
  Payload ID: 2204
  Gene Symbol: CAPN3
  Gene Name: calpain 3
  Uniprot ID: P20807
  ENST ID: ENST00000397204
  CDS Start-End: 225-695
cacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggtaggaagaacaaacccttgtccctttgccatgtggaggaaagtgcctgcctctggtccgagccgcctcggttctgaagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctgg

SEQ ID NO: 113614 - DNA, 908 bp, Homo sapiens
  Payload ID: 2204
  Gene Symbol: CAPN3
  Gene Name: calpain 3
  ENST ID: ENST00000569827
  CDS Start-End: 142-908
cagtcacacagacgcgttctgagggtggctgcccgcttgggatggaggaatcacttccctcagaacccagccaagtcctctaggcctccttgggggtccttccagcctgaggggcttcggagctgaggagcagctgttctgatgcacgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttct

SEQ ID NO: 113615 - DNA, 598 bp, Homo sapiens
  Payload ID: 2204
  Gene Symbol: CAPN3
  Gene Name: calpain 3
  ENST ID: ENST00000568153
  CDS Start-End: 1-203
gattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgagcgagtgctcctgcttaccttgctctaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggc

SEQ ID NO: 113616 - DNA, 1029 bp, Homo sapiens
  Payload ID: 2204
  Gene Symbol: CAPN3
  Gene Name: calpain 3
  Uniprot ID: P20807
  ENST ID: ENST00000569136
  CDS Start-End: 390-860
ataatcctgaccctgagccagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatc

SEQ ID NO: 113617 - DNA, 711 bp, Homo sapiens
  Payload ID: 2204
  Gene Symbol: CAPN3
  Gene Name: calpain 3
  ENST ID: ENST00000567817
  CDS Start-End: 1-282
aaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggacccagcagctacacccctacaggcttccaggcacctcatcagtcatgctcctcctccattttaccccctacccatccttgatcggtcatgcctagcctgaccctttagtaaagcaatgaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgta

SEQ ID NO: 113618 - DNA, 915 bp, Homo sapiens
  Payload ID: 2204
  Gene Symbol: CAPN3
  Gene Name: calpain 3
  ENST ID: ENST00000561817
  CDS Start-End: 240-815
cagtgccaggtctccaagtgccttctgaatgaccacaggcgattggttttagtggtaggtgtgtggggatctgttctggtcatctggatgctggtcatcggtgtgcagtattgatcaggacctgcaaacccaaaagcttatgggagctggcacgtcacccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggaggctgtctgcagaagcacctgccggtggcactcagcacctccttgtgctagagccctccatcaccttcacgctgtcccaccatgggccaggaaccaaaccagcactgggttctactgctgtggggtaaactaactcagtggaatagggctggttactttgggctgtccaactcataagtttggctgcattttgaaaaaagctgatctaaataaaggcatgtgtatggctggtc

SEQ ID NO: 113619 - DNA, 563 bp, Homo sapiens
  Payload ID: 2204
  Gene Symbol: CAPN3
  Gene Name: calpain 3
  ENST ID: ENST00000567071
  CDS Start-End: 1-563
cgggaacaagcagcacctgcagaaggacttcttcctgtacaacgcctccaaggccaggagcaaaacctacatcaacatgcgggaggtgtcccagcgcttccgcctgcctcccagcgagtacgtcatcgtgccctccacctacgagccccaccaggagggggaattcatcctccgggtcttctctgaaaagaggaacctctctgaggaagttgaaaataccatctccgtggatcggccagtgaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacagttttcctttgtgcctccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactgg

SEQ ID NO: 113620 - DNA, 734 bp, Homo sapiens
  Payload ID: 2204
  Gene Symbol: CAPN3
  Gene Name: calpain 3
  ENST ID: ENST00000565274
  CDS Start-End: 1-333
aaaaaaaccaagcccatcatcttcgtttcggacagagcaaacagcaacaaggagctgggtgtggaccaggagtcagaggagggcaaaggcaaaacaagccctgataagcaaaagcagtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatccctgacctccctcctccagacagatggctctggaaagctcaacctgcaggagttccaccacctctggaacaagattaaggcctggcagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaaggaccca

SEQ ID NO: 113621 - DNA, 711 bp, Homo sapiens
  Payload ID: 2204
  Gene Symbol: CAPN3
  Gene Name: calpain 3
  ENST ID: ENST00000565559
  CDS Start-End: 239-711
tctgttctggtcatctggatgctggtcatcggtgtgcagtattgatcaggacctgcaaacccaaaagcttatgggagctggcacgtcacaaaaagaaaaaaaccaagcccatcatcttcgtttcggacagagcaaacagcaacaaggagctgggtgtggaccaggagtcagaggagggcaaaggcaaaacaagccctgataagcaaaagcagtccccacaggtgtctgggcatgtggcatgggtggggtggccagcacgctacaggggcttcctatgcgcttgggatacacaggggctggaggcttcccaggagtttgtcttgaacatctggagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagaaaattttcaaacactatgacacagaccagtccggcaccatcaacagctacgagatgcgaaatgcagtcaacgacgcaggattccacctcaacaaccagctctatga

SEQ ID NO: 113622 - DNA, 593 bp, Homo sapiens
  Payload ID: 2204
  Gene Symbol: CAPN3
  Gene Name: calpain 3
  ENST ID: ENST00000564503
  CDS Start-End: 1-509
agtccccacagccacagcctggcagctctgatcaggaaagtgaggaacagcaacaattccggaacattttcaagcagatagcaggagatgacatggagatctgtgcagatgagctcaagaaggtccttaacacagtcgtgaacaaacacaaggacctgaagacacacgggttcacactggagtcctgccgtagcatgattgcgctcatggatacagatggctctggaaagctcaacctgcaggagttccaccacctctggaacaagattaaggcctggcagatgcgaaatgcagtcaacgacgcaggattccacctcaacaaccagctctatgacatcattaccatgcggtacgcagacaaacacatgaacatcgactttgacagtttcatctgctgcttcgttaggctggagggcatgttcagagcttttcatgcatttgacaaggatggagatggtatcatcaagctcaacgttctggagtggctgcagctcaccatgtatgcctgaaccaggctggcctcatccaaagccatgcaggatcactcaggatttcagtttcaccctctatttccaaagccatttacctcaaag

SEQ ID NO: 113623 - DNA, 4397 bp, Homo sapiens
  Payload ID: 2205
  Gene Symbol: CAPN5
  Gene Name: calpain 5
  Uniprot ID: O15484
  ENST ID: ENST00000278559
  CDS Start-End: 190-2112
gaatgcgagcgccagcccccgccgcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccggcctctgccttgggcctcgcctctgtcctcaggtcctctcagaggcagatacctaggggagctgctgctgcctgctcattctagcttccgattccattcccagcccctgcgttaaggtccctggagaggtggcgtcagtgggggtgaggaagggcatcttcctgactcctctgcccagtgctggaaggagcatgcctgggttagtgggccaggggccaggcagctgggggcctttggggaccagaaggggagatgtgctcccagagcctctctgctgtaagaccccagcttttcctggaagatgggactctggggtgtgtggtgctcaccagagtcaggccacccactgggctcggcaggagatagggagccccatcacctgaccacagccccccaccaacattcccccaaaatgcagcctaggaggccgcagtgctcttcttcctgcccagaccaaaatgttccttttagtcctcaatgttttatattctttttgttttgaaaatctcaattttaatcaggggttttaaaagaaaattgaaagcctgaacctccatttttcttcttggctccagttttgctggtcctctggagaactcttcgtgagcactggtgccgtgacccacttgggatctctgctgtgcccttctcgggcttccagaccaggtgtagcaaatgaaaaagtgcagttaattcaagaacaggaatccctgtgtccttgctgggatttccttttgggaacctgactttccgactccagatcctgctgtctggatcagtgttctggctggaggtgctggattctctgattttgcctcctcactctgtgtctggctttgctcctgggtcttggccctgggccatatgaggggccaggaaatgaacgacaaggaggataagagtgttctttcttgaaagccgggacttcccctcaagaacctgggcctggggccgggactctgcatgactgggagcaagtcacttaaacctcctgtgcctcgatttcccccttctacaaagtggggccaatgattcttgtgtgtcagcactgttactaccgagtgctgagtaagggcaaaataatacccctttctctatgtatctctgtatgcacacgcactatatatatatatatatatatatatacattcatgtaatcaccacttctcgatgtctatttcaaatcaaggctcctgagtagggggtgaagtgagccagcttgcacctcaggctaacacataggactttgctcagccatgtcccctgggatacaggggcacaccaggaccaagtggcagacctgtgggcttcagcctcggggccggggcatgcctgccaccccctgacaaaaacaggttccacagtgctacccttgcttcctgccccttgaggtgggccaggctggctcctggctatgcagggatctctggtccccaggagaccttgggggccaggcaggtaaggatcaggggtgataggggagagcaattactttgttcactgtatgcacccgcgggggcctgggagtccccatttgcaggtgggtagggcctccagcccacaccacccagacctaggcttccctcttctcaggatccaccacagggttaggggacaggaagcctgttctattctcaataaatcttacaaaattccaaaaa

SEQ ID NO: 113624 - DNA, 2805 bp, Homo sapiens
  Payload ID: 2205
  Gene Symbol: CAPN5
  Gene Name: calpain 5
  ENST ID: ENST00000456580
  CDS Start-End: 138-2180
agagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagtacagtggccattcgctggcccctcacaggcctggctggggagatgcacggagaatggagaatgtccccaggcctgggagctcagggtgtccgtcctcctcgctcagggcccgggacctgggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttgtttacacacgaactgccacatccccaagctccgttcttgcccctcgtgtcctaggcccaacccagcctcccagacctcactttccccatcagcaatacctggtgttctcccaccttgaaaggactcttggctcctgccgggttcctgctcaggctggaattgggaaaatatgcaggtgacatttgttcattctctaatcccatcctctcacccatccatttcctcactcagtggagatttgccaaatgaataaacgacacctttgaggccccaggtgaagcggggccctactccgg

SEQ ID NO: 113625 - DNA, 2333 bp, Homo sapiens
  Payload ID: 2205
  Gene Symbol: CAPN5
  Gene Name: calpain 5
  Uniprot ID: O15484
  ENST ID: ENST00000529629
  CDS Start-End: 227-2149
agctggatctccggccagagcccgaggctgctgcgccgggcggctgcagcctccgctccagcgcccgcgccgtgccctgcatcccgggagcccggctggacccgcggcggctcggccgatgagaattctgaagcacaaagaggttaactgctttgcacctcgctggcctcagtctccccatctgaggacgggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggggaatgggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcatt

SEQ ID NO: 113626 - DNA, 597 bp, Homo sapiens
  Payload ID: 2205
  Gene Symbol: CAPN5
  Gene Name: calpain 5
  ENST ID: ENST00000527066
  CDS Start-End: 307-597
agtcccagctggatctccggccagagcccgaggctgctgcgccgggcggctgcagcctccgctccagcgcccgcgccgtgccctgcatcccgggagcccggctggacccgcggcggctcggccggttgtctctccggtggggagtgagcgagcacacagcccccaccccaccccgggtgagagagaatgtcctgcacagggacgcccagctgtatctacctgctgtcagcactttctctgcaggacctggtgctggactgggagccccgaggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtgg

SEQ ID NO: 113627 - DNA, 534 bp, Homo sapiens
  Payload ID: 2205
  Gene Symbol: CAPN5
  Gene Name: calpain 5
  ENST ID: ENST00000531028
  CDS Start-End: 199-357
gaacccggggaatgcgagcgccagcccccgccgcaggccagtcccagctggatctccggccagagcccgaggctgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgca

SEQ ID NO: 113628 - DNA, 2374 bp, Homo sapiens
  Payload ID: 2205
  Gene Symbol: CAPN5
  Gene Name: calpain 5
  ENST ID: ENST00000615896
  CDS Start-End: 126-2045
tgctgcgccgggcggctgcagcctccgctccagcgcccgcgccgtgccctgcatcccgggagcccggctggacccgcggcggctcggccggtgttccccctcccctccctggggcagcagccaccatgttctcgtgtgtgaagccctatgaggaccagaactactcagccctgaggcgggactgccggcgcaggaaggtgctcttcgaggaccccctcttccccgccactgacgactcactctactataagggcacgccggggcccgccgtcaggtggaagcgacccaagggcatctgcgaggacccccgcctctttgtggatggcatcagctcccacgacctgcaccagggccaggtgggcaactgctggtttgtggcagcctgctcgtcacttgcctcccgggagtcgctgtggcaaaaggtcatcccagactggaaggagcaggaatgggaccccgaaaagcccaacgcctacgcgggcatcttccacttccacttctggcgcttcggaatggtggacgtggtcatcgatgaccggctgcccacagtcaacaaccagctcatctactgccactccaactcccgcaatgagttttggtgcgccctagtggagaaggcctatgccaaactggcaggctgttaccaggccctggatggaggcaacacagcagacgcactggtggacttcacgggtggtgtttctgagcccatcgacctgaccgagggtgactttgccaacgatgagactaagaggaaccagctctttgagcgcatgttaaaggtgcacagccggggcggcctcatcagtgcctccatcaaggcagtgacagcagctgacatggaggcccgcctggcgtgcggcctggtaaagggccacgcatacgccgtcactgatgtgcgcaaggtgcgcctgggccacggcctactggccttcttcaagtcagagaagttggacatgatccgcctgcgcaacccctggggcgagcgggagtggaacgggccctggagtgacacctcggaggagtggcagaaagtgagcaagagtgagcgggagaagatgggtgtgaccgtgcaggacgacggtgagttctggatgaccttcgaggacgtgtgccggtacttcacggacatcatcaagtgccgcgtgatcaacacatcccacctgagcatccacaagacgtgggaggaggcccggctgcatggcgcctggacgctgcatgaggacccgcgacagaaccgcggtggcggctgcatcaaccacaaggacaccttcttccagaacccacagtacatcttcgaagtcaagaagccagaagatgaagtcctgatctgcatccagcagcggccaaagcggtctacgcgccgggagggcaagggtgagaacctggccattggctttgacatctacaaggtggaggagaaccgccagtaccgcatgcacagcctgcagcacaaggccgccagctccatctacatcaactcacgcagcgtcttcctgcgcaccgaccagcccgagggccgctatgtcatcatccccacaaccttcgagccaggccacactggcgagttcctgctccgagtcttcactgatgtgccctccaactgccgggagctgcgcctggatgagcccccacacacctgctggagctccctctgtggctacccccagctggtgacccaggtacatgtcctgggagctgctggcctcaaggactccccaacaggggctaactcttatgtgatcatcaagtgtgagggagacaaagtccgctcggctgtgcagaagggcacctccacaccagagtacaatgtgaaaggcatcttctaccgcaagaagctgagccagcccatcactgtacaggtctggaaccaccgagtgctgaaggatgaatttctgggccaggtgcacctaaaggctgacccggacaacctccaggccctgcataccctccacctccgggaccgaaatagccggcagcccagcaacctgccaggcactgtggccgtgcacattctcagcagcacctccctcatggctgtctgacacctgcccacctacctggctctgaccgttcccaccaccatctgcatgtccccactgggcctgagtctagcctgggagccaggatactggggtccttttcccactcttccactgacttgctgtgtgaccttaggaagtctctgcccctctctcagcctcagtgtcccgagggccccgaagcattccattctcgtggaggagtttccttgctgagatttcaaatagtcctccccacctcaactgtcaccactgctaagggactctatccattgagcacattttcctaaggccctgctgtctgccgaggagcgccaagaagatgtcacttg

SEQ ID NO: 113629 - DNA, 3568 bp, Homo sapiens
  Payload ID: 2206
  Gene Symbol: CAPN6
  Gene Name: calpain 6
  Uniprot ID: Q9Y6Q1
  ENST ID: ENST00000324068
  CDS Start-End: 169-2094
atagttttcaggttaagaaagccagaatctttgttcagccacactgactgaacagacttttagtggggttacctggctaacagcagcagcggcaacggcagcagcagcagcagcagcagcagcagcagcagcagggctcctgggataactcaggcatagttcaacactatgggtcctcctctgaagctcttcaaaaaccagaaataccaggaactgaagcaggaatgcatcaaagacagcagacttttctgtgatccaacatttctgcctgagaatgattctcttttctacaaccgactgcttcctggaaaggtggtgtggaaacgtccccaggacatctgtgatgacccccatctgattgtgggcaacattagcaaccaccagctgacccaagggagactggggcacaagccaatggtttctgcattttcctgtttggctgttcaggagtctcattggacaaagacaattcccaaccataaggaacaggaatgggaccctcaaaaaacagaaaaatacgctgggatatttcactttcgtttctggcattttggagaatggactgaagtggtgattgatgacttgttgcccaccattaacggagatctggtcttctctttctccacttccatgaatgagttttggaatgctctgctggaaaaagcttatgcaaagctgctaggctgttatgaggccctggatggtttgaccatcactgatattattgtggacttcacgggcacattggctgaaactgttgacatgcagaaaggaagatacactgagcttgttgaggagaagtacaagctattcggagaactgtacaaaacatttaccaaaggtggtctgatctgctgttccattgagtctcccaatcaggaggagcaagaagttgaaactgattggggtctgctgaagggccatacctataccatgactgatattcgcaaaattcgtcttggagagagacttgtggaagtcttcagtgctgagaaggtgtatatggttcgcctgagaaaccccttgggaagacaggaatggagtggcccctggagtgaaatttctgaagagtggcagcaactgactgcatcagatcgcaagaacctggggcttgttatgtctgatgatggagagttttggatgagcttggaggacttttgccgcaactttcacaaactgaatgtctgccgcaatgtgaacaaccctatttttggccgaaaggagctggaatcggtgttgggatgctggactgtggatgatgatcccctgatgaaccgctcaggaggctgctataacaaccgtgataccttcctgcagaatccccagtacatcttcactgtgcctgaggatgggcacaaggtcattatgtcactgcagcagaaggacctgcgcacttaccgccgaatgggaagacctgacaattacatcattggctttgagctcttcaaggtggagatgaaccgcaaattccgcctccaccacctctacatccaggagcgtgctgggacttccacctatattgacacccgcacagtgtttctgagcaagtacctgaagaagggcaactatgtgcttgtcccaaccatgttccagcatggtcgcaccagcgagtttctcctgagaatcttctctgaagtgcctgtccagctcagggaactgactctggacatgcccaaaatgtcctgctggaacctggctcgtggctacccgaaagtagttactcagatcactgttcacagtgctgaggacctggagaagaagtatgccaatgaaactgtaaacccatatttggtcatcaaatgtggaaaggaggaagtccgttctcctgtccagaagaatacagttcatgccatttttgacacccaggccattttctacagaaggaccactgacattcctattatagtacaggtctggaacagccgaaaattctgtgatcagttcttggggcaggttactctggatgctgaccccagcgactgccgtgatctgaagtctctgtacctgcgtaagaagggtggtccaactgccaaagtcaagcaaggccacatcagcttcaaggttatttccagcgatgatctcactgagctctaaatctgcaatcccagagaatcctgacaaagcgtgccacccttttattttccgtcaggtgccaggtcttagttaagattcacaatctttagaaagaatgagattcacaataattaactcttcctctcttctgataaattccccatacctcccaatccaagtagcatctgtagctacataacctatatacctccagcagctggacatggggaggcgacagtcctatctagacatcatacacatttgccaagaaaggatctctggggcttccgggggtgagattcaagtaggacaataacaagaggctggacaccctacagatgtctttgatgttttcagttgtttgatatatctcccctgtagggcatgttgaggaaggaggagggctgatcaaggccaagctggtctagcctgacatcctagctcctgactgaacactatagacttcccagcagcatttcacccagcagccagagccggctttaagtccccaacccttacagacaccactgccaccaccaccaaccacgaccaccaccaccaccaccactcaccaccatcatcacctccggaaagtgtagtcctgccctaacccaagtcacccccgacagtaaattttaccttcatgttgagaaagcttcctggtgcttaatcaagagctggagttcaatgagtcctagacagtgagaggggcctgagcttcagctcaatggaagcctgctgtgtgccacaagacggaaaagtggaagaagctgcagtgggagacaaagcctcggtcccccacccatccacacacacctacactcacacacgcgcacatgggcgcgcacgaactaccattcaggcagtcagtgggcaagaggaaagataagtaagtaccatacacacctaaaagatgagagaattcatccagacatattacagccagtttggggcccctgactgcaatgtgaaacctctcgctgctgctaggtttacaaacaagcccattgtcctgtgcctcctaatatcatttgtactgaagaccccatctggggacttgagactttggtcccagcccagactcctcagacttttctctcagttgggatgcttcactcgctgggggtgtttgtttgccctctcatttttcagtacttctacagaattttctctagagtcagtcattatgaaatgtacttccctccatcttaacctatcaactttctgcccctccttcaaggcccagtataaatgccacctcctccatgaagccttccctaattccaccccaaacccccaccttcaacaatatttcaacgcttctgcaatgatgaaaaagaaacatagttgtagtacttagcctacctagaccagcaagcattcatttttagctcgctcattttttaccatgttttccagtctgtttaacttctgcagtgccttcactacactgccttacataaaccaaatcacaataaagttcatattcagtaca

SEQ ID NO: 113630 - DNA, 4353 bp, Homo sapiens
  Payload ID: 2207
  Gene Symbol: CAPN7
  Gene Name: calpain 7
  Uniprot ID: Q9Y6W3
  ENST ID: ENST00000253693
  CDS Start-End: 254-2695
ggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggacaacatcaaaaataaatggtatagaatatgttcctttcatgaatgttgacctgagagaacgttttgcctatccaatgcctttctgtgatagatggggcaagctaccattatcacctaaacaaaaaactacattttccaagtgggtacgaccagaagacctcaccaacaatcctacaatgatatatactgtgtccagttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaaggtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacagtacttgggatgctaagcaaggacctgtgaaagatgcctatagcctggccaacaacccccagtacaaactggaggtgcagtgtccacaggggggtgctgcagtttgggttttgcttagtagacacataacagacaaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggcaatatagcgttggatttgaggttgtaacagtttctactctaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatcacacaacttcagtgatggagaaatctcaagttactggcttttatacttaccaaacatcagttcttcaaataaggacgcaaatcttcaggacagtaagcagaacaatcagaatggaattaaatctctaaaaacgtgttacagtggaatctggtgcttgtcagggtgtttggtaagaactgtatatagtcagaattacctaaatcacctagaggtaccgtttacatggttttgtgtatatagagttggcttgcattttaggggccattttgtataaaaagtgcatatgattaaaattagactcagtcatcactgtgagatgcctttgctaagaggataaaggaactgagaccagatgagaaaaagaaaggatatagattccttgagtggaatagtgggctagattaatataccgaaatatttccattgtttcccttttttgcagagcatgtggaagttaaacctgcttgattctactatacatcttgggcaactagttaccaaatgaattgtgccaccataactgattttaattttgcattatttatgattttaaaatatttgttgcccaggtgttatgaaagaataaagcttttaagtatagactaccttagcatgaagatgctcatgcctaagaatgaaaattgttgaggttatctcccattcaatcatgtagcaagaacttaaagaaattcactactgcagtttttatttttaaaaaacagtaattgagatattgaagacattacaatttagtttgtgtggtctttttttaaattgctgtatcgttcagtctcttgtggcaatagcactttgaagaaaatagagaatttaatatatggtgattgggatatgtagcattcaaaaaaagtgaattgccaagatactggtgtcatgtaaattcccactttacataaaaacccatcaggacagaatgatgctcaatattttaaaattctaaaaatagggtgggatttttcattgtctctactttataattatcaaaacttattttgtattgctactaccttaaattgaaataaaatgtttatacttacggatattgcatagtttaagttagatttattgaaagatttcatctgtcgtgtttcatgtaaatgagaacagattatttgcatgaaaatatatacttcaacaaaaatctgttctttaacagagtagtggtagattattacactaatgagatttcactttggtaaatacttcatgctttcagttttagcctattaattttaggtggacaaatttaacaagttttctgttactttttaaaaagaaaaaatccagaacataagaactatattatgaacacatgatttgaacctgttgtggtaaagatcttgtacaggatgcaaactaaaaacctaatccctgccatcaaatttattagaagagacctatatatgaacaacttaaaggcactgatttctataatagagctctaaaaacatgccaccagtgtatgaataagggaaagattaattttggctggaccaatataaaaaattgtatttgaagaattgatactttaacttggaccttgaaggtaaagcttcaaaagacaggttactgaccattgagtgtttactatgtacccaatgtgtatatttttctttttaatcttcccaatagctgaataaagtatagatactatt

SEQ ID NO: 113631 - DNA, 854 bp, Homo sapiens
  Payload ID: 2207
  Gene Symbol: CAPN7
  Gene Name: calpain 7
  ENST ID: ENST00000457023
  CDS Start-End: 276-404
gcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaagttcagtcaaagagtgctgatcctttgaagtcaaaacatcagttggacttagagcgtgctcatttccttgttacacaagcttttgatgaagatgaaaaagagaatgttgaagatgctatagaattgtacacagaagctgtggatctctgtctgaaaacatcttatgaaactgctgataaagtcctgcaaaataaactgaaacagttggctcgacaggcactagacagagcagaagcgctgagtgagcctttgaccaagccagttggcaaaatcagttcaacaagtgttaagccaaagccacctccagtgagagcacattttccactgggcgctaatcccttccttgaaagacctcagtcatttataagtcctcagtcatgtgatgcacaaggacagagatacacagcagaagaaatagaagtactcaggtaaataagtttacaattaattgtaatgaagaattttgttaacatgaatg

SEQ ID NO: 113632 - DNA, 805 bp, Homo sapiens
  Payload ID: 2207
  Gene Symbol: CAPN7
  Gene Name: calpain 7
  ENST ID: ENST00000443567
  CDS Start-End: 1-339
catttacgttggaaaggaagatacagtgaaaatgatgtaaaaaactggactccagagttgcaaaagtatttaaactttgatccccgaacagctcagaaaatagacaacggaatattttggatttcctgggatgatctctgccagtattatgatgtgatttatttgagttggaatccaggtctttttaaagaatcaacatgtattcacaggatgattttgcgaataatcgagaatttatcacaatggttgtatacaagactgatgggaaaaaagtttattacccagctgacccacctccatacattgatggaattcgaattaacagccctcattatttgactaagataaagctgaccacacctggcacccatacctttacattagtggtttctcaatatgaaaaacagaacacaatccattacacggttcgggtatattcagcatgcagctttactttttcaaagattccttcaccatacaccttatcaaaacggattaatggaaagtggagtggtcagagtgctggaggatgtggaaatttccaagagactcacaaaaataaccccatctaccaattccatatagaaaagactgggccgttactgattgagctacgaggaccaaggagatcctggtccccatggctttctgaggaaatctagtggtgactataggtgtgggttttgctacctggaattagaaaatataccttctgggatcttcaatatcattcctagtacctttttgcctaaacaagaaggaccttttttcttggactttaatagtattatccccatcaagatca

SEQ ID NO: 113633 - DNA, 742 bp, Homo sapiens
  Payload ID: 2207
  Gene Symbol: CAPN7
  Gene Name: calpain 7
  ENST ID: ENST00000415565
  CDS Start-End: 1-742
ttttagcataaagcagacaatagtatcggattgctcctttgtggcatcactggccatcagtgcagcttatgaaagacgttttaataagaagttaattaccggcataatttaccctcaaaacaaggatggtgaaccagaatacaatccatgtgggaagtatatggtaaaacttcacctcaatggtgtcccaagaaagaatacctacaagttgaacatctctaatctgaaaatccaaaacactccagtgataattgatgaccagttacctgttgatcacaagggagaattgctctgttcttattccaacaacaaaagtgaattatgggtttctctcatagaaaaagcatacatgaaagtcatgggaggatatgattttccaggatccaactccaatattgatcttcatgcactgactggctggataccagaaagaattgctatgcattcagatagccaaactttcagtaaggataattctttcagaatgctttatcaaagatttcacaaaggagatgtcctcatcactgcgtcaactggaatgatgacagaagctgaaggagagaagtggggtctggttcccacacacgcatatgctgttttggatattagagagttcaaggggctgcgatttatccagttgaaaaatccttggagtcatttacgttggaaaggaagatacagtgaaaatgatgtaaaaaactggactccagagttgcaaaagtatttaaactttgatccccga

SEQ ID NO: 113634 - DNA, 781 bp, Homo sapiens
  Payload ID: 2207
  Gene Symbol: CAPN7
  Gene Name: calpain 7
  ENST ID: ENST00000418994
  CDS Start-End: 345-455
gcgcagtcccgcgagcctggcctcggcggccccagcttctaaggagctcgtgagggccaggctgcgcctgcgtcgggcggctggtgggcggggcgagggccgctggggccgcgaagtggggcggccgggtgggctacaagccgggtctgggctgaggggcgcggcttcgcggtggaccccagcccggcaacgggaaggcgagctctcctccaccgtccaaagtaaactttgccgctccttccgcggcgctcccgagtcctcgccgccgccgggccgccgcagtccgcgaagagccgtcctgcgtcagggcctccttccctgccccggcgcggggccactgcgccatggacgccacagcactggagcgggacgctgtgcagttcgcccgtctggcggttcagcgcgaccacgaaggccgctactccgaggcggtgttttattacaaggttcagtgaaacaactcctgctcaaacaactggattcaaaaagtgatgttcagtagatggcatctttggaaacaggcatgatgacccatgaagtgtacacgcttgggttactgcagagaaggaagctgcacaagccttaatttatgctgagatggcaggatcaagcctagaaaatattcaagaaaaaataactgagtatctggaaagagttcaagctctacattcagcagttcagtcaaagagtgctgatcctttgaagtcaaaacatcagttggacttagagcgtgctcatttccttgttacacaagcttttgatgaagatgaaaaagagaatg

SEQ ID NO: 113635 - DNA, 2427 bp, Homo sapiens
  Payload ID: 2208
  Gene Symbol: CAPN8
  Gene Name: calpain 8
  Uniprot ID: A6NHC0
  ENST ID: ENST00000366872
  CDS Start-End: 89-2200
gtgccttatagctcccctcccagtggagcaggtgtctgagagtacagtgcagccctgcccttctgtccaccctacagagcccacggccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccagccacgtactggaccaatccccagttcaaaatccgtttggatgaagtggatgaggaccaggaggagagcatcggtgaaccctgctgtacagtgctgctgggcctgatgcagaaaaatcgcaggtggcggaagcggataggacaaggcatgcttagcatcggctatgccgtctaccaggttcccaaggagctggagagtcacacggacgcacacttgggccgggatttcttcctggcctaccagccctcagcccgcaccagcacctacgtcaacctgcgggaggtctctggccgggcccggctgccccctggggagtacctggtggtgccatccacatttgaacccttcaaagacggcgagttctgcttgagagtgttctcagagaagaaggcccaggccctagaaattggggatgtggtagctggaaacccatatgagccacatcccagtgaggtggatcaggaagatgaccagttcaggaggctgtttgagaagttggcagggaaggattctgagattactgccaatgcactcaagatacttttgaatgaggcgttttccaagagaacagacataaaattcgatggattcaacatcaacacttgcagggaaatgatcagtctgttggatagcaatggaacgggcactttgggggcggtggaattcaagacgctctggctgaagattcagaagtatctggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatggtttc

SEQ ID NO: 113636 - DNA, 2596 bp, Homo sapiens
  Payload ID: 2208
  Gene Symbol: CAPN8
  Gene Name: calpain 8
  ENST ID: ENST00000366873
  CDS Start-End: 78-1223
ctcccctcccagtggagcaggtgtctgagagtacagtgcagccctgcccttctgtccaccctacagagcccacggccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccaggctcctcctaggttgaatcagctgaggcagcacctgatgaagaaactcaggaagacagccccacatctctaaggagaaatgaagaaaagcaaatcctgctctctctacttttcacctcctgctccccatgttccctgcctggtttgctgttgatctgttgattgacttagactgtaagcgcatggggcagggccagtcactttcttctcatgacagagctcactgcagggctgtgctcggtgctagggaagcagcattagaataaaaccccacctggatgcagtgctgggtcttgacaagttctctcttctttcatcacccatccaacccaaagctcccggttcaggcagctgtgaccagagtgctgaacagagaggaaggaaaggggtccacatcctgcccttgttgcttgatttagactctgggaagggcatttccctcttctgagcttcagtttcctagtcctccagatggggttcaaccttccaaccttactgggtcactgcaagccttggaacacagagtgtgtagggaagcactttgtaaactgtgtagcattatataaatgggagtattatttttatggcccattctcttcctccagtactgttaaggagtaaacaaaaaatgtatggattgcagtaatgttgcatttgggagaaattaaaatatgctcaccattagcaagctcttagaaaatgtggaggaaatttgcatggatcattttgggagctcagaactgtagggggtgcacaaggtatctggatgcaccaaatcacagtcccatccatgctgccaactagctgtcaggaagacatggatagttcctgccctttggtagtgatggaagtataggcgattacagatttttttttccatctcctatgggatccacagatatccggctttaaaatccataaacttgagccctaaaacaaacaaacaaacaaaacacagcaacaaaaaaacaaaacaaaacaaaacaaacaacccccccccccaaaaaaaaagtggaagtggggattctgagaaggtggaattgaataagtaatcctactgtaaagaaaagtgataatcaatggctcttggtcacctgtgaatgccttgttattttccaagttagactcttctttaaaggatgtaaggaaaaatcccatgcccttccacttcttttttcctcccgggcacatcattattgaaattgttgaggccctagagtggagacacctgtcaggcgtgccttctgcaattttgctctgccactggactctgtcatagacttgctgcatatccttggatgatccttttaatctctccgtgccttggcttgtgtacttactattctgagagatttaaaaaaagccatctttgaaatgaaggagtc

SEQ ID NO: 113637 - DNA, 695 bp, Homo sapiens
  Payload ID: 2208
  Gene Symbol: CAPN8
  Gene Name: calpain 8
  ENST ID: ENST00000430824
  CDS Start-End: 1-471
gattctgagattactgccaatgcactcaagatacttttgaatgaggcgttttccaagagaacagacataaaattcgatggattcaacatcaacacttgcagggaaatgatcagtctgttggatagcaatggaacgggcactttgggggcggtggaattcaagacgctctggctgaagattcagaagtatctggagatctattgggaaactgattataaccactcgggcaccatcgatgcccacgagatgaggacagccctcaggaaggcaggtttcaccctcaacagccaggtgcagcagaccattgccctgcggtatgcgtgcagcaagcttggcatcaactttgacagcttcgtggcttgtatgatccgcctggagaccctcttcaaactattcagccttctggacgaagacaaggatggcatggttcagctctctctggccgagtggctgtgctgcgtgttggtctgacccggggtttcggacatcagtgacactccctgccccactgcttgcttcttgtcaccccttctctacaattttgtgaacatttatgctccagtggcattcactggttgttcatacctttcttgccctgggtctatttcagcagcactgagctatgagctatgtaagccgacccggtgggcccagtggagggaaagcaatcaattaaagttgtgagccagaatggt

SEQ ID NO: 113638 - DNA, 1399 bp, Homo sapiens
  Payload ID: 2208
  Gene Symbol: CAPN8
  Gene Name: calpain 8
  ENST ID: ENST00000419193
  CDS Start-End: 89-1399
gtgccttatagctcccctcccagtggagcaggtgtctgagagtacagtgcagccctgcccttctgtccaccctacagagcccacggccatggcagcccaggcagctggtgtatctaggcagcgggcagccactcaaggtcttggctccaaccaaaacgctttgaagtacttgggccaggatttcaagaccctgaggcaacagtgcttggactcaggggtcctatttaaggaccctgagttcccagcatgtccatcagctttgggctacaaggatcttggaccaggctctccgcaaactcaaggcatcatctggaagcggcccacggagttgtgtcccagccctcagtttatcgttggtggagccacgcgcacagacatttgtcagggtggtctaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaattctggatgtcactttcagatttcgtgaggcagttctctcggttggagatctgcaacctgtccccggactctctgagtagcgaggaggtgcacaaatggaacctggtcctgttcaacggccactggacccggggctccacagctgggggctgccagaactacccagccacgtactggaccaatccccagttcaaaatccgtttggatgaagtggatgaggaccaggaggagagcatcggtgaaccctgctgtacagtgctgctgggcctgatgcagaaaaatcgcaggtggcggaagcggataggacaaggcatgcttagcatcggctatgccgtctaccag

SEQ ID NO: 113639 - DNA, 327 bp, Homo sapiens
  Payload ID: 2208
  Gene Symbol: CAPN8
  Gene Name: calpain 8
  ENST ID: ENST00000442247
  CDS Start-End: 1-306
gattctgagattactgccaatgcactcaagatacttttgaatgaggcgttttccaagagaacagacataaaattcgatggattcaacatcaacacttgcagggaaatgatcagtctgttggatgaagaaacacaagacaccatgcaagtcccagactcatctgagaccttctggaacacggaagctgacattttggacacagtgagaagatggccctctatgaaccaggaagggggccctcacagacaccagatctgccagtgctttgatcttggacttctcagccttcgaaactatgagaaataaatttctgttgtttataaggca

SEQ ID NO: 113640 - DNA, 884 bp, Homo sapiens
  Payload ID: 2208
  Gene Symbol: CAPN8
  Gene Name: calpain 8
  ENST ID: ENST00000467384
  CDS Start-End: 1-117
gagttgtgtcccagccctcagtttatcgttggtggagccacgcgcacagacatttgtcagggtggtctagaaacgagatggatgagaattggcctggtgggcttcagaagcaactaggaggaactctgaaataatctgaacaagtttcttcagctgtgaagagtttgcttgcttttttttctttttctttttccttttcctctccactgaaaacttagaaggtgactgctggcttctggctgccattgcctccctgaccctgaatgaagagctgctttaccgggtggtccccagggaccaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgatgcaccagagtggaatcacatagacccccggcggaaggaagaactggacaagaaagttgaggatggagaat

SEQ ID NO: 113641 - DNA, 710 bp, Homo sapiens
  Payload ID: 2208
  Gene Symbol: CAPN8
  Gene Name: calpain 8
  ENST ID: ENST00000465098
  CDS Start-End: 1-521
accaggacttccaggagaactatgcgggaatctttcactttcagttctggcagtacggagagtgggtggaggtggtcattgacgacaggctgcccaccaagaatggacagctgctcttcctacactcggaacaaggcaatgaattctggagtgccctgctggagaaagcctatgccaagcttaatggttgttatgaggctctcgctggaggttccacagtggaggggtttgaggatttcacaggtggcatctctgagttttatgacctgaagaaaccaccagccaatctatatcagatcatccggaaggccctctgtgcggggtctctgctgggctgctccattgatgtctccagtgcagccgaagccgaagccatcaccagccagaagctggttaagagtcatgcgtactctgtcactggagtcgaagaggtgaatttccagggccatccagagaagctgatcagactcaggaatccatggggtgaagtggagtggtcgggagcctggagcgatgagtaggtttttttcccccgcttctccagtcatctctccctctgcggaagggtgtcgtgtaaaacacacaacaatgagatcgatgtcacagtgagttcagcagcacgtcctgtctgcagatcacacagtgtgttcagaaaagagtattaaatggatccaggctgggaaaagcaaaataaaaaccactgggctgta

SEQ ID NO: 113642 - DNA, 364 bp, Homo sapiens
  Payload ID: 2208
  Gene Symbol: CAPN8
  Gene Name: calpain 8
  ENST ID: ENST00000484873
  CDS Start-End: 1-62
aactattcagccttctggacgaagacaaggatggcatggttcagctctctctggccgagtaaataggaagaaacacaagacaccatgcaagtcccagactcatctgagaccttctggaacacggaagctgacattttgagatggggtttcaccacattacccaggctggtcttgaactctgggactcaagcaatctgcccacctcagcctcccaaagtgctgagattacaggacacagtgagaagatggccctctatgaaccaggaagggggccctcacagacaccagatctgccagtgctttgatcttggacttctcagccttcgaaactatgagaaataaatttctgttgtttataaggcac

SEQ ID NO: 113643 - DNA, 2362 bp, Homo sapiens
  Payload ID: 2209
  Gene Symbol: CAPN9
  Gene Name: calpain 9
  Uniprot ID: O14815
  ENST ID: ENST00000271971
  CDS Start-End: 114-2186
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacagttctccggagtggcgttctgttggtccagctgagcagaagcgtctgtgtcacactgctctggatgatggggaattctggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctga

SEQ ID NO: 113644 - DNA, 2484 bp, Homo sapiens
  Payload ID: 2209
  Gene Symbol: CAPN9
  Gene Name: calpain 9
  Uniprot ID: O14815
  ENST ID: ENST00000354537
  CDS Start-End: 83-2077
tcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccaggggaaatcgtgaaaaacccagaattcattcttggaggggccaccaggactgatatctgccagggagagctgggagactgctggctattagccgccatcgcctcccttacgcttaatcaaaaagcactggccagagtcatcccccaggaccaaagctttggccctggttatgccgggatattccatttccagttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacaggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctgattttgtgctactcctttgtaaagtcactgccttaagggggctgatggcgccacctgtgccttacatccaggttcaggcatcactagctttcccacactctactttccttatttccttccattaagaattactcagagttctaacgcacagaatcctgacttccatgtagctccagtcattgtgatcagacatcctttataaaacatgtttttataaatgtgtatgtggaat

SEQ ID NO: 113645 - DNA, 2173 bp, Homo sapiens
  Payload ID: 2209
  Gene Symbol: CAPN9
  Gene Name: calpain 9
  ENST ID: ENST00000366666
  CDS Start-End: 114-1997
actcagcccagtggccctctgagctgttccttcttgaccggcacacacagctcgcttcttcactttcttttccatccactgccggacccaagccagccttccagggagcagccatgccttacctctaccgggccccagggcctcaggcacacccggttcccaaggacgcccggatcacccactcctcaggccagagctttgagcaaatgaggcaggagtgcctgcagagaggcaccctgtttgaggatgcagacttcccagccagcaattcctccctgttctacagtgagaggccgcagatcccctttgtgtggaaacgaccagggttctggcagcacagtgagtggctggacgtggtgatcgatgaccgcctgcccaccttcagggaccgcttggttttcctccactctgccgaccacaacgagttctggagcgccttgctggaaaaagcctacgccaagctaaatgggagctatgaagctctgaagggaggcagcgccatcgaggccatggaagacttcactgggggtgtggcagagaccttccaaactaaagaggcccccgagaacttctatgagattctagagaaggctttgaagagaggctccctgctgggctgcttcattgataccagaagtgctgcagaatctgaggcccggacgccgtttggtcttattaagggtcatgcctacagtgtaacgggaattgaccaggtaagcttccgaggccagagaatcgagctcatccgaatccggaacccttggggccaggttgagtggaacgggtcgtggagcgacagttctccggagtggcgttctgttggtccagctgagcagaagcgtctgtgtcacactgctctggatgatggggaattctggatggcatttaaggacttcaaggcccactttgataaagtggagatctgcaacctcactcccgatgccctggaggaagacgcgatccacaaatgggaggtgacggtccatcagggaagctgggttcgcggctccacggctgggggctgccgcaatttcctggataccttttggaccaatccacaaataaaattgtctctgactgagaaagatgaggggcaggaggagtgtagtttccttgtagccctgatgcagaaagatagaaggaaactcaagagatttggtgccaatgtgctgacaatcggctatgccatttatgagtgccctgacaaagacgaacacctgaacaaagacttcttcagataccacgcttctcgggccagaagcaagacgttcatcaacctgagagaagtctccgaccggttcaagctgccccctggggagtacatcctgattcccagcacttttgagccccaccaggaagctgatttctgtctgagaatcttttcagagaaaaaagccattacccgggatatggatggaaatgtagacattgaccttcctgagcctccaaagccaactccacctgaccaggagacagaggaggagcagcggtttcgggctctgtttgaacaagtcgctggtgaggacatggaggtgacagcagaggaacttgagtatgttttaaatgctgtgctgcaaaagaaaaaggacatcaaattcaagaagctaagcctgatctcctgtaaaaacatcatttccctgatggacaccagcggcaatgggaagctggagtttgatgaattcaaagtgttctgggacaagctgaagcagtggattaaccttttccttcggtttgatgctgacaagtccggcaccatgtctacctatgaactacggactgcactgaaagctgcaggctttcagctgagcagccacctcctgcagctgattgtgctcaggtatgcggatgaggagctccagctggacttcgatgacttcctcaactgcctggtccggctggagaatgcgagccgggtgttccaggctctcagtacaaagaacaaggagttcattcatctcaatataaatgagttcatccatttgacaatgaacatctgaggctgccttgtagagatgcagcctgcccagctgaatcttggcttctggaccttgaccttcagaacttctcttggtgtggaaccattacgcccagggttcactcccctctcatcgtccggccttctcccttcatcttgatctgggaagaatgaaatgaactcagctacactctctga

SEQ ID NO: 113646 - DNA, 1918 bp, Homo sapiens
  Payload ID: 2210
  Gene Symbol: CAPNS1
  Gene Name: calpain, small subunit 1
  Uniprot ID: P04632
  ENST ID: ENST00000246533
  CDS Start-End: 599-1405
tgccatccgggctgctgcaggcactgggaaaggcaatccagcctcaatcctcgccacagacacgggcgactgtcccccagcgtgtgagtcaaaccatactccaggcctccaggaggtgtttgtcgcgacaacacctgcagagggcccgtgcggagtcccttagtgagcggaccgaaaaccgccaccctggaaggatattggcatgccctagggtgaaaattcacactacgacactcggggggtgggtcccctccgagttctcgtccgcgggtgcctccacccagacctgaggggtgtcgggaagacccccgcctaccgagtcagggcgggattaagacctccggcgctggaaacgcgtagggcggggcccagacctggatccagctagccgggcggtgtggggtgcgcatgcgcaatgtccgcttcggctctaggaccgcgcgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctct

SEQ ID NO: 113647 - DNA, 1471 bp, Homo sapiens
  Payload ID: 2210
  Gene Symbol: CAPNS1
  Gene Name: calpain, small subunit 1
  Uniprot ID: P04632
  ENST ID: ENST00000588815
  CDS Start-End: 152-958
ccgactcccagaactccggacgtgtgcggcggtaagcgcccggcccgtaccccctccgcaccccgcaactccgactttggcggcccccagacccggcgaaaccgtgaagtctcggcctcaggagccccccagatccatgtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctct

SEQ ID NO: 113648 - DNA, 616 bp, Homo sapiens
  Payload ID: 2210
  Gene Symbol: CAPNS1
  Gene Name: calpain, small subunit 1
  ENST ID: ENST00000586851
  CDS Start-End: 1-589
aacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcac

SEQ ID NO: 113649 - DNA, 926 bp, Homo sapiens
  Payload ID: 2210
  Gene Symbol: CAPNS1
  Gene Name: calpain, small subunit 1
  ENST ID: ENST00000590874
  CDS Start-End: 48-764
ggaaccgactcccagaactccggacgtgtgcggcgtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccggacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatcca

SEQ ID NO: 113650 - DNA, 1035 bp, Homo sapiens
  Payload ID: 2210
  Gene Symbol: CAPNS1
  Gene Name: calpain, small subunit 1
  ENST ID: ENST00000588780
  CDS Start-End: 45-881
cacccactggtccccttttttccccccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatctgtcactcttcttaacaccctcccaccagagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctc

SEQ ID NO: 113651 - DNA, 812 bp, Homo sapiens
  Payload ID: 2210
  Gene Symbol: CAPNS1
  Gene Name: calpain, small subunit 1
  ENST ID: ENST00000591041
  CDS Start-End: 322-812
tttgctccgcgcccatgacctgccaaggacctctacattcaggctgggctctggatctcacattctagcgcccagacatgtcgggaacgccttacgccaacttggggtccccaccaagagaacccccaccagatctgcaccctccccttcacgcgtgcacccagtccaggctccctcaagccccacgggtgccttttagacctgaggaggttgcaaacctgatcccccatacctgccccacccatccgcggacaacccgccctcgcaaactcagacccccacccggaggcttcagattcctcccagcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaatt

SEQ ID NO: 113652 - DNA, 578 bp, Homo sapiens
  Payload ID: 2210
  Gene Symbol: CAPNS1
  Gene Name: calpain, small subunit 1
  ENST ID: ENST00000589146
  CDS Start-End: 221-505
atccagctagccgggcggtgtggggtgcgcatgcgcaatgtccgcttcggctctaggaccgcgcgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggcc

SEQ ID NO: 113653 - DNA, 1558 bp, Homo sapiens
  Payload ID: 2210
  Gene Symbol: CAPNS1
  Gene Name: calpain, small subunit 1
  ENST ID: ENST00000587718
  CDS Start-End: 66-1034
cccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggaggtaaggacccccatattggggtatgggtgcctgggaggaccccacccctcagcccttcataccagctctgagctgcagtccccttcctcctattttgccagccgtccctgggtgagggcaaaggggctggtgctcttggggttccctgtcctcactctccaccctcctctccccagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatc

SEQ ID NO: 113654 - DNA, 431 bp, Homo sapiens
  Payload ID: 2210
  Gene Symbol: CAPNS1
  Gene Name: calpain, small subunit 1
  ENST ID: ENST00000592483
  CDS Start-End: 215-431
cgggagcggcagtggaaccgactcccagaactccggacgtgtgcggcggcccataggtttcagagataccctgtgaattcttccttggggtgtcctgaaccgcgatcgtagatctgtgcccccagttccagcggggaaccccattgtccgggaacccagagctcacagccacgatcttagacccgagcccacagagccagagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcgg

SEQ ID NO: 113655 - DNA, 592 bp, Homo sapiens
  Payload ID: 2210
  Gene Symbol: CAPNS1
  Gene Name: calpain, small subunit 1
  ENST ID: ENST00000590049
  CDS Start-End: 1-592
ggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggcccaggaggaaataaacatgccccagttgctgatctcta

SEQ ID NO: 113656 - DNA, 403 bp, Homo sapiens
  Payload ID: 2210
  Gene Symbol: CAPNS1
  Gene Name: calpain, small subunit 1
  ENST ID: ENST00000590211
  CDS Start-End: 1-164
gcatcctaggcggagtcatcagcgccatcagcgaggcggctgcgcagtacaacccggagcccccgcccccacgcacacattactccaacattgaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatc

SEQ ID NO: 113657 - DNA, 690 bp, Homo sapiens
  Payload ID: 2210
  Gene Symbol: CAPNS1
  Gene Name: calpain, small subunit 1
  ENST ID: ENST00000592354
  CDS Start-End: 390-690
aaaatagaataggattaacctggaggctaacctgggtacatgaattaggccggggaggcctggtttgagagttctgctgtaagggggtggaccccagtgaggcggatatcagtcattgggggcggtgcttgatatgggagtagtctgattgtgtgggaccaggacaatgtggtcctgaggggactgatgtggagttttggcgggtggggcttatgggtctgggctcagcctgcattggctaacctggagatgaacgttaaagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatga

SEQ ID NO: 113658 - DNA, 570 bp, Homo sapiens
  Payload ID: 2210
  Gene Symbol: CAPNS1
  Gene Name: calpain, small subunit 1
  ENST ID: ENST00000586963
  CDS Start-End: 87-570
tttacggaaggggcttgacttatgagtgtggtcagaggttttaggtgggttaatgaggaggtgagcccaggaggaagcaagacctaatgggcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttca

SEQ ID NO: 113659 - DNA, 799 bp, Homo sapiens
  Payload ID: 2210
  Gene Symbol: CAPNS1
  Gene Name: calpain, small subunit 1
  ENST ID: ENST00000629983
  CDS Start-End: 1-285
atgttcctggttaactcgttcttgaagggcggcggcggcggcggcgggggaggcgggggcctgggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctcta

SEQ ID NO: 113660 - DNA, 1389 bp, Homo sapiens
  Payload ID: 2210
  Gene Symbol: CAPNS1
  Gene Name: calpain, small subunit 1
  ENST ID: ENST00000628306
  CDS Start-End: 159-875
gcgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccggacatggaggtcagcgccacagaactcatgaacattctcaataaggttgtgacacgacaccctgatctgaagactgatggttttggcattgacacatgtcgcagcatggtggccgtgatggatagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctcta

SEQ ID NO: 113661 - DNA, 1509 bp, Homo sapiens
  Payload ID: 2210
  Gene Symbol: CAPNS1
  Gene Name: calpain, small subunit 1
  ENST ID: ENST00000628018
  CDS Start-End: 159-995
gcgggcgacagcagggccgcggtgcagtgtccgacccgagagttgcggcctgagtcaccggccccgccctccggagccggacgctgcgggaggcccgggagcggcagtggaaccgactcccagaactccggacgtgtgcggcgcagtgagtcgcagccatgttcctggttaactcgttcttgaagggcggcggcggcggcggcgggggaggcgggggcctgggtgggggcctgggaaatgtgcttggaggcctgatcagcggggccgggggcggcggcggcggcggcggcggcggcggcggtggtggaggcggcggtggcggtggaacggccatgcgcatcctaggcggagtcatcagcgccatcagcgaggcggctgcgcagtacaacccggagcccccgcccccacgcacacattactccaacattgaggccaacgagagtgaggaggtccggcagttccggagactctttgcccagctggctggagatgacatggaggtcagcgccacagaactcatgaacattctcaataaggttgtgacacgacaccctgatctgaagactgatggttttggcattgacacatgtcgcagcatggtggccgtgatggatctgtcactcttcttaacaccctcccaccagagcgacaccacaggcaagctgggctttgaggaattcaagtacttgtggaacaacatcaaaaggtggcaggccatatacaaacagttcgacactgaccgatcagggaccatttgcagtagtgaactcccaggtgcctttgaggcagcagggttccacctgaatgagcatctctataacatgatcatccgacgctactcagatgaaagtgggaacatggattttgacaacttcatcagctgcttggtcaggctggacgccatgttccgtgccttcaaatctcttgacaaagatggcactggacaaatccaggtgaacatccaggagtggctgcagctgactatgtattcctgaactggagccccagacccgccccctcactgccttgctataggagtcacctggagcctcggtctctcccagggccgatcctgtctgcagtcacatctttgtggggcctgctgacccacaagcttttgttctctcagtacttgttacccagcttctcaacatccagggcccaatttgccctgcctggagttccccctggctctaggacactctaacaagctctgtccacgggtctccccattcccaccaggccctgcacacacccactccgtaacctctcccctgtacctgtgccaagcctagcacttgtgatgcctccatgccccgagggccctctctcagttctgggaggatgactccagtccctgcacgccctggcacacccttcacggttgctacccaggcggccaagctccagaccgtgccagacccaggtgccccagtgcctttgtctatattctgctcccagcctgccaggcccaggaggaaataaacatgccccagttgctgatctcta

SEQ ID NO: 113662 - DNA, 1016 bp, Homo sapiens
  Payload ID: 2211
  Gene Symbol: CAPNS2
  Gene Name: calpain, small subunit 2
  Uniprot ID: Q96L46
  ENST ID: ENST00000457326
  CDS Start-End: 86-832
cacatgtaaactacttgaactccatttcatcttttttcataccatctctaagattgctgccgcatttgcttgttaaactgaaagcatgtttcttgcaaaggctctattggaaggagcagatcgaggtcttggagaagctcttggaggcctctttggaggaggtggtcagagaagagaaggaggaggaagaaatattggagggatagttggaggaattgtgaattttatcagtgaggctgcagcagctcagtatactccagaaccgcctcccactcagcagcatttcaccagtgtggaggcctcagaaagtgaggaagttaggcgatttcggcaacaatttacacagctggctggaccagacatggaggtgggtgccactgatctgatgaatattctcaacaaagtcctttctaagcacaaagatcttaagactgacggttttagtcttgacacctgccggagcattgtgtctgtcatggacagtgacacgactggtaagctgggctttgaagaatttaagtatctgtggaacaacatcaagaaatggcagtgtgtttataagcagtatgacagggaccattctgggtctctgggaagttctcagctgcggggagctctgcaggccgcaggcttccagctaaatgaacaactttaccaaatgattgtccgccggtatgctaatgaagatggagatatggattttaacaatttcatcagctgcttggtccgcctggatgccatgtttcgtgccttcaagtctctggatagagatagagatggcctgattcaagtgtctatcaaagaatggctgcagttgaccatgtattcctgaagtgggaactgagaagtcaagatcctccctggaggacaggactgaaaaccttgccaagctgtacacagttgctgataccctgtgcaacagctctcatttcctggcaagctctttcacaaccctacatatttctgatcatgtgctgccttttactgctgaattaaaacagatatttcacgaaaaa

SEQ ID NO: 113663 - DNA, 4282 bp, Homo sapiens
  Payload ID: 2212
  Gene Symbol: CAST
  Gene Name: calpastatin
  Uniprot ID: P20810
  ENST ID: ENST00000309190
  CDS Start-End: 155-2215
cactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 113664 - DNA, 3356 bp, Homo sapiens
  Payload ID: 2212
  Gene Symbol: CAST
  Gene Name: calpastatin
  ENST ID: ENST00000325674
  CDS Start-End: 1-1293
atgggccagtttctatcttcgactttcttggagggctcaccggccacagtgtggcacgataagctttgtgacggtgaacgcagaggagcaagagaagcagttcgtatcttccaggaccaagcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacatt

SEQ ID NO: 113665 - DNA, 2487 bp, Homo sapiens
  Payload ID: 2212
  Gene Symbol: CAST
  Gene Name: calpastatin
  Uniprot ID: P20810
  ENST ID: ENST00000341926
  CDS Start-End: 163-2289
acattggtaaggtgttttcccccattgaaactaatattttctattttcaagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttc

SEQ ID NO: 113666 - DNA, 2972 bp, Homo sapiens
  Payload ID: 2212
  Gene Symbol: CAST
  Gene Name: calpastatin
  Uniprot ID: P20810
  ENST ID: ENST00000338252
  CDS Start-End: 268-2355
tctgggcatcgaaggaggaacgctgcaacctccaaccccttctttctgaccaaccgggaccagagcagtgctggggccggggcgggtcaccggcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcacc

SEQ ID NO: 113667 - DNA, 4506 bp, Homo sapiens
  Payload ID: 2212
  Gene Symbol: CAST
  Gene Name: calpastatin
  Uniprot ID: P20810
  ENST ID: ENST00000395812
  CDS Start-End: 187-2439
ggcccatcggggctaggggaaccccggcgcagacctggggtggggtcggaaaagctgtttcatcgcccgctcccgggccctccgctccctccctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 113668 - DNA, 4356 bp, Homo sapiens
  Payload ID: 2212
  Gene Symbol: CAST
  Gene Name: calpastatin
  Uniprot ID: P20810
  ENST ID: ENST00000395813
  CDS Start-End: 167-2293
cccgccccgtcgcactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacatt

SEQ ID NO: 113669 - DNA, 913 bp, Homo sapiens
  Payload ID: 2212
  Gene Symbol: CAST
  Gene Name: calpastatin
  ENST ID: ENST00000421689
  CDS Start-End: 1-913
atgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacct

SEQ ID NO: 113670 - DNA, 3377 bp, Homo sapiens
  Payload ID: 2212
  Gene Symbol: CAST
  Gene Name: calpastatin
  ENST ID: ENST00000437034
  CDS Start-End: 1-1310
agaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaatataaaaagaaacttctgcttttaaaaaaattatatatatatattaaatttgaaacctgcatttctcccacagcaatgtaagaagtaggctctgatgtcctaccactttgaatggttttctaatatcttaatgaatagttcctgaacattgcactgatatcatcgattagaattttgatatttaatttcatctttatttcctggtagagaatgcaggaaaagatgtcaggtacataacataaaacagattgggaatttattgtttccaaagggcatggccttccttagcatcagtttgaagcttttgttatgacttagctgacttgtggcagcggggcaagcaaaaacaataacactgcttataaatggcaccacatcttgttaacctcccccccaaatactctctgaaagtcatgcacatacctatgggattttacacaccaccagcttaaaatgctatgtctctatccatcagaaatagtcattattctatttttaaggcagcaacaagaaaagaaaaaacacttttcctgagggatttctaaccatgtatctaatcctcccatttgggcagtataggtgtttgcttttttgttttctttttttaagaaaaaccttgaaacctttgacactgacagatgtgtttgcaaggatacggcttcagtattactaatttccatgtgtatctggaagtatttttaaatggcataccaaaatccagaagtttaaagatgcctataaaagtaaacaacatttatttaaaaagaactctgaatatgccttcttttttaattagaaatatcttcgagacttgggtgtttgttaataactaataactggagtaagctacaggatctaaagcagccctttttacagtctagttaggagagagaaaataattgcaaatatccacttagaggcaaagaacaattttttattatcaaaaaggtttctgcacattgttgtggcaatattgtatctgtttagaaaatgggcttttccaaaagcaaacaaagataggttcctcaggtgaccaaaactgaaaatcaatatttccatgtttcattaatcaaggcataaaatacaattaaagcaaaatattttacattaaaa

SEQ ID NO: 113671 - DNA, 3273 bp, Homo sapiens
  Payload ID: 2212
  Gene Symbol: CAST
  Gene Name: calpastatin
  ENST ID: ENST00000511049
  CDS Start-End: 238-2319
gcactcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaagataaaataaaattatacctggggctgtgctcttatattaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattcttcagtgttctgatttcttattaccccctttcctcttgggcttttgaactgtatttgatgttgctttgggataatgtttataagtcaaacataagatattgtacattgggcacatatctcctcttgggctgctaataataaattaataacaggtaacctggacaaaccaggaagcaccaaaccccttttcagtttgaactcttctttgccaggtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggtactcatctgacttgaactctgttggtttactgtgttagtaaactgtgctttctattatctatacataaaacctgagcagcaactgtgtctttagagctattgccacattagcctttgcactgtatagcgtctggctttatggaacttaagtttaccaaa

SEQ ID NO: 113672 - DNA, 559 bp, Homo sapiens
  Payload ID: 2212
  Gene Symbol: CAST
  Gene Name: calpastatin
  ENST ID: ENST00000514055
  CDS Start-End: 113-559
agtgccagcccggtcccggccaagcggagtgtgagcccggcgcctccaacgcaacaccccgcgccctcgccggctcccccgccgtgcggatcggagccagccggttgttgccatggcattcgccagctggtggtacaagacgcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaag

SEQ ID NO: 113673 - DNA, 2310 bp, Homo sapiens
  Payload ID: 2212
  Gene Symbol: CAST
  Gene Name: calpastatin
  Uniprot ID: P20810
  ENST ID: ENST00000510756
  CDS Start-End: 1-2310
atgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaa

SEQ ID NO: 113674 - DNA, 2079 bp, Homo sapiens
  Payload ID: 2212
  Gene Symbol: CAST
  Gene Name: calpastatin
  ENST ID: ENST00000510156
  CDS Start-End: 154-2079
actcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaag

SEQ ID NO: 113675 - DNA, 571 bp, Homo sapiens
  Payload ID: 2212
  Gene Symbol: CAST
  Gene Name: calpastatin
  ENST ID: ENST00000508117
  CDS Start-End: 153-401
ctcagagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagaggcacctgtgtgtgtactttcagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaat

SEQ ID NO: 113676 - DNA, 588 bp, Homo sapiens
  Payload ID: 2212
  Gene Symbol: CAST
  Gene Name: calpastatin
  ENST ID: ENST00000514845
  CDS Start-End: 138-588
agccgccttgggatgtgcggagctcagtgccagcccggtcccggccaagcggagtgtgagcccggcgcctccaacgcaacaccccgcgccctcgccggctcccccgccgtgcggatcggagccagccggttgttgccatggcattcgccagctggtggtacaagacgcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagc

SEQ ID NO: 113677 - DNA, 2425 bp, Homo sapiens
  Payload ID: 2212
  Gene Symbol: CAST
  Gene Name: calpastatin
  ENST ID: ENST00000508608
  CDS Start-End: 85-2349
gtgtgagcccggcgcctccaacgcaacaccccgcgccctcgccggctcccccgccgtgcggatcggagccagccggttgttgccatggcattcgccagctggtggtacaagacgcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaa

SEQ ID NO: 113678 - DNA, 499 bp, Homo sapiens
  Payload ID: 2212
  Gene Symbol: CAST
  Gene Name: calpastatin
  ENST ID: ENST00000503828
  CDS Start-End: 265-499
aaggcagcaggggccacttcaagcttccctgcttcctaagcttaggttgtcagaagcctttttagagatacatttttagaaaaagaaaaatagtgtggtaacagtttactacttgcttcttttttttttgtttgtttagagtattttatagtaatattactatagctttatgtctagcttaccaaataaggggtgaagtgtgccccagagaacgctgttactgtagaaacgtgtcttagccccaatttccactcattggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaaggttagga

SEQ ID NO: 113679 - DNA, 567 bp, Homo sapiens
  Payload ID: 2212
  Gene Symbol: CAST
  Gene Name: calpastatin
  ENST ID: ENST00000508197
  CDS Start-End: 99-567
aggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatata

SEQ ID NO: 113680 - DNA, 1473 bp, Homo sapiens
  Payload ID: 2212
  Gene Symbol: CAST
  Gene Name: calpastatin
  ENST ID: ENST00000515663
  CDS Start-End: 88-1383
gtcacttcctgttctgagtcatcagggaaggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacag

SEQ ID NO: 113681 - DNA, 1399 bp, Homo sapiens
  Payload ID: 2212
  Gene Symbol: CAST
  Gene Name: calpastatin
  ENST ID: ENST00000511097
  CDS Start-End: 221-1399
ggagcccgggtccctccgcgggcaggaaggggagggcccatcggggctaggggaaccccggcgcagacctggggtggggtcggaaaagctgtttcatcgcccgctcccgggccctccgctccctccctccctccctctctccctggcaggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacg

SEQ ID NO: 113682 - DNA, 864 bp, Homo sapiens
  Payload ID: 2212
  Gene Symbol: CAST
  Gene Name: calpastatin
  ENST ID: ENST00000505143
  CDS Start-End: 1-864
ggagaggtgccttctgccatgattgtaagtttcctgaggccttcccagccattcagaactcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggct

SEQ ID NO: 113683 - DNA, 2466 bp, Homo sapiens
  Payload ID: 2212
  Gene Symbol: CAST
  Gene Name: calpastatin
  ENST ID: ENST00000511782
  CDS Start-End: 212-2296
agagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggtatgaagaatgctaattgagccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattctttt

SEQ ID NO: 113684 - DNA, 565 bp, Homo sapiens
  Payload ID: 2212
  Gene Symbol: CAST
  Gene Name: calpastatin
  ENST ID: ENST00000509259
  CDS Start-End: 291-565
gatcagccattgtgccttcagagaagaaggcagcaggggccacttcaagcttccctgcttcctaagcttaggttgtcagaagcctttttagagatacatttttagaaaaagaaaaatagtgtggtaacagtttactacttgcttcttttttttttgtttgtttagagtattttatagtaatattactatagctttatgtctagcttaccaaataaggggtgaagtgtgccccagagaacgctgttactgtagaaacgtgtcttagccccaatttccactcattggatacaatgagtgatcaagcactcgaggctctgtcggcttcactgggcacccggcaagcagaacctgagctcgacctccgctcaattaaggaagtcgatgaggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcgga

SEQ ID NO: 113685 - DNA, 1835 bp, Homo sapiens
  Payload ID: 2212
  Gene Symbol: CAST
  Gene Name: calpastatin
  ENST ID: ENST00000510500
  CDS Start-End: 1-1396
gcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaagaaatatatttgataaagtttcttaaagcaacaccaaaaaaacaaaagaaaagctaagtgaatttttgcacattctacacacagtgcctgtaaatctcatttgtattttcagtttgcccttaattttttttgttagtgtttagaaaacaatgttttaaacattc

SEQ ID NO: 113686 - DNA, 2336 bp, Homo sapiens
  Payload ID: 2212
  Gene Symbol: CAST
  Gene Name: calpastatin
  ENST ID: ENST00000504465
  CDS Start-End: 150-2060
agagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtaag

SEQ ID NO: 113687 - DNA, 2539 bp, Homo sapiens
  Payload ID: 2212
  Gene Symbol: CAST
  Gene Name: calpastatin
  Uniprot ID: P20810
  ENST ID: ENST00000508830
  CDS Start-End: 164-2539
ctgggcatcgaaggaggaacgctgcaacctccaaccccttctttctgaccaaccgggaccagagcagtgctggggccggggcgggtcaccgggactccccgccaggcctccccgccactctccgcggcgcattccgggaggcagcggccgcagcggcctcgccatgtcccagcccggccagaagcccgccgcctccccgcggccccggcgagcagccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaa

SEQ ID NO: 113688 - DNA, 1758 bp, Homo sapiens
  Payload ID: 2212
  Gene Symbol: CAST
  Gene Name: calpastatin
  ENST ID: ENST00000508579
  CDS Start-End: 290-1561
ataaaaccttcaagtttgattgtataaaggactttgagccctgaggatcactagagggacaccaagtagctggtactgcccagcattctcaactatatttcactatgacataattctcacaaatcgcaaaaggcaatcctgcagctctgtgctggctgggaacacatgtctcctctgcaaacagtcaagataatgctcaggaacggtttctatcagagcagcttgtgcctctcccctcctggagtggacagtttatttttatctggcaggctggggaacagtggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggtt

SEQ ID NO: 113689 - DNA, 904 bp, Homo sapiens
  Payload ID: 2212
  Gene Symbol: CAST
  Gene Name: calpastatin
  ENST ID: ENST00000512620
  CDS Start-End: 1-904
ccgccgcccgccgcacccatgagcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaaaaggaagggatcacagggcctcctgcagactcttcgaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggtata

SEQ ID NO: 113690 - DNA, 2171 bp, Homo sapiens
  Payload ID: 2212
  Gene Symbol: CAST
  Gene Name: calpastatin
  ENST ID: ENST00000509903
  CDS Start-End: 150-2171
agagagctgggctggagctccaagcggaaaccgcgggagccgagcccagctaggaatgcagacctcctgaaaaccaagccgaggactgcggggtccggtgtccacgcagagtgtcagcttcctctggtgcaaccagcaagtcttccagtatgaatcccacagaaaccaaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctgaacagcagccatcagagaaatcaacagaaccaaagactaaaccacaagacatgatttctgctggtggagagagtgttgctggtatcactgcaatatctggcaagccgggtgacaagaaaaaagaaaagaaatcattaaccccagctgtgccagttgaatctaaaccggataaaccatcgggaaagtcaggcatggatgctgctttggatgacttaatagatactttaggaggacctgaagaaactgaagaagaaaatacaacgtatactggaccagaagtttcagatccaatgagttccacctacatagaggaattgggtaaaagagaagtcacaattcctccaaaatatagggaactattggctaaacccatagggccagatgatgctatagacgccttgtcatctgacttcacctgtgggtcgcctacagctgctggaaagaaaactgaaaaagaggaatctacagaagttttaaaagctcagtcagcagggacagtcagaagtgctgctccaccccaagagaagaaaagaaaggtggagaaggatacaatgagtgatcaagcactcgaggctctgtcggcttcactgggcacccggcaagcagaacctgagctcgacctccgctcaattaaggaagtcgatgaggcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaa

SEQ ID NO: 113691 - DNA, 582 bp, Homo sapiens
  Payload ID: 2212
  Gene Symbol: CAST
  Gene Name: calpastatin
  ENST ID: ENST00000506811
  CDS Start-End: 113-582
agtgccagcccggtcccggccaagcggagtgtgagcccggcgcctccaacgcaacaccccgcgccctcgccggctcccccgccgtgcggatcggagccagccggttgttgccatggcattcgccagctggtggtacaagacgcatgtcagtgaaaaaaccagtgaatcgccttccaaaccaggagaaaagaaaggatcagatgagaaaaaagcagcaagcctcggcagcagtcaatcctccagaacctatgctggtggaacagcctcggccaccaaggtgtcagcttcctctggtgcaaccagcaagtcttccagtatgaatcccacagaaaccaaggccattccagtcagccaacagatggaaggaccacatcttcctaacaagaaaaaacacaaaaaacaggctgtaaaaacagaacctgagaagaagtcacagtcaaccaagctgtctgtggttcatgagaaaaaatcccaagaaggaaagccaaaagaacacacagagccaaaaagcctacccaagcaggcatcagatacaggaagtaacgatgctcacaataaaaaagcagtttccagatcagctga

SEQ ID NO: 113692 - DNA, 1323 bp, Homo sapiens
  Payload ID: 2212
  Gene Symbol: CAST
  Gene Name: calpastatin
  ENST ID: ENST00000510098
  CDS Start-End: 1-612
atgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgcagagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacacactgagacttgaatcaagtcagcaacagagcaaaataaagatgcaaacttcgttttttaaaaacatgatatctaaaaagcagaatgtgcagagtcttttctttgccaagcaaaacagtttccaccacatcttgtctatagatgactacctttctggtcaaggctttggacatctcttcagtcatcagacagagtatctctgctctagacctcgctggagttcaagcttgaattattatatgcaagttaattttacaagcctggatgaggctactgaaaactggaaaaaagctacgagactgtaacaacccttcattctttttcatttccaaagctctctccccatctcaagctagaaaatagtgtaaccagactacacaatggaaccactcctaaaaaaat

SEQ ID NO: 113693 - DNA, 1767 bp, Homo sapiens
  Payload ID: 2212
  Gene Symbol: CAST
  Gene Name: calpastatin
  ENST ID: ENST00000484552
  CDS Start-End: 1-1351
ggggagtctccctgacttccagcaacaatccttgagtctgggactgccctggcctaagatgggccagtttctatcttcgactttcttggagggctcaccggccacagtgtggcacgataagctttgtgacggtgaacgcagaggagcaagagaagcagttcgtatcttccaggaccaagcaaaagctaaagaagaaaaactagagaagtgtggtgaggatgatgaaacaatcccatctgagtacagattaaaaccagccacggataaagatggaaaaccactattgccagagcctgaagaaaaacccaagcctcggagtgaatcagaactcattgatgaactttcagaagattttgaccggtctgaatgtaaagagaaaccatctaagccaactgaaaagacagaagaatctaaggccgctgctccagctcctgtgtcggaggctgtgtgtcggacctccatgtgtagtatacagtcagcaccccctgagccggctaccttgaagggcacagtgccagatgatgctgtagaagccttggctgatagcctggggaaaaaggaagcagatccagaagatggaaaacctgtgatggataaagtcaaggagaaggccaaagaagaagaccgtgaaaagcttggtgaaaaagaagaaacaattcctcctgattatagattagaagaggtcaaggataaagatggaaagccactcctgccaaaagagtctaaggaacagcttccacccatgagtgaagacttccttctggatgctttgtctgaggacttctctggtccacaaaatgcttcatctcttaaatttgaagatgctaaacttgctgctgccatctctgaagtggtttcccaaaccccagcttcaacgacccaagctggagccccaccccgtgatacctcgagtgacaaagacctcgatgatgccttggataaactctctgacagtctaggacaaaggcagcctgacccagatgagaacaaaccaatggaagataaagtaaaggaaaaagctaaagctgaacatagagacaagcttggagaaagagatgacactatcccacctgaatacagacatctcctggatgataatggacaggacaaaccagtgaagccacctacaaagaaatcagaggattcaaagaaacctgcagatgaccaagaccccattgatgctctctcaggagatctggacagctgtccctccactacagaaacctcacagaacacagcaaaggataagtgcaagaaggctgcttccagctccaaagcacctaagaatggaggtaaagcgaaggattcagcaaagacaacagaggaaacttccaagccaaaagatgactaaagaaatacaagttaaggtatctggtatctgcatgtaaaatcttcagctggtggatggtgacttttgaagaacaaaaggctttggcaacagaaaacaattgttctgggtgatttctagaatggtttttgttgagtctctgaacatcctaaatattggtttgttattcttttccagaaagaaaatgaatttgactggttcacctgtgtactgagtattgataaactttgaatttttttaattgccttcaattgggagagaaagctttatatttgtgtgaggacttctgcatcttacagtcagcacagaacacactgagacttgaatcaagtcagcaacagagcaaaataaaggttagataagtccttgtgtagcaaatttcgagcataagaaataaaatctaattaattcttagggta

SEQ ID NO: 113694 - DNA, 1633 bp, Homo sapiens
  Payload ID: 2213
  Gene Symbol: CNN1
  Gene Name: calponin 1, basic, smooth muscle
  Uniprot ID: P51911
  ENST ID: ENST00000252456
  CDS Start-End: 212-1105
gggaggggaaggcagctgaggttgtggggggaggtgccccgccccttggcaggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatctc

SEQ ID NO: 113695 - DNA, 1527 bp, Homo sapiens
  Payload ID: 2213
  Gene Symbol: CNN1
  Gene Name: calponin 1, basic, smooth muscle
  ENST ID: ENST00000535659
  CDS Start-End: 579-1322
acagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagggggaagacttgttgatttttccatatcccccggcctgacaaagaaattggggagcgcttgagtgctggggtacctgggaagtgacgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtcccaggtaaagcagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctaca

SEQ ID NO: 113696 - DNA, 565 bp, Homo sapiens
  Payload ID: 2213
  Gene Symbol: CNN1
  Gene Name: calponin 1, basic, smooth muscle
  ENST ID: ENST00000586059
  CDS Start-End: 216-565
gcgcagagccgcgcagagacgccgcgccttataaggcggcctcggggagcccgggccacgctatataagggccggtttgctttataaagccgggctggtggcgtggggggcggcagggccagggccagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgca

SEQ ID NO: 113697 - DNA, 685 bp, Homo sapiens
  Payload ID: 2213
  Gene Symbol: CNN1
  Gene Name: calponin 1, basic, smooth muscle
  ENST ID: ENST00000586577
  CDS Start-End: 1-520
gaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggtgagtgggggcccccgggacacgccgtcaaggcccaggaccctggccaccccacggcctgaccacaccacccttcgcaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctga

SEQ ID NO: 113698 - DNA, 700 bp, Homo sapiens
  Payload ID: 2213
  Gene Symbol: CNN1
  Gene Name: calponin 1, basic, smooth muscle
  ENST ID: ENST00000588935
  CDS Start-End: 1-686
cagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctggcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatc

SEQ ID NO: 113699 - DNA, 1848 bp, Homo sapiens
  Payload ID: 2213
  Gene Symbol: CNN1
  Gene Name: calponin 1, basic, smooth muscle
  ENST ID: ENST00000592923
  CDS Start-End: 578-1321
aggcccctacagccaatggaacggccctggaagagacccgggtcgcctccggagcttcaaaaacatgtgaggagggaagagtgtgcagacggaacttcagccgctgcctctgttctcagcgtcagtgccgccactgcccccgccagagcccaccggccagcatgtcctctgctcacttcaaccgaggccctgcctacgggctgtcagccgaggttaagaacaagggggaagacttgttgatttttccatatcccccggcctgacaaagaaattggggagcgcttgagtgctggggtacctgggaagtgacgccgtgaaagtgtgggagatcctgaagacagagggggacggtgaaaggcaggaagcgggcatcagaagtgcggcaggggtctcctgactgtggagctaggaagatacctggacaccaccttcatgctatggttgggtaaactgaggttcggagaggagaggcaaatagctggggtcccagctggcccagaagtatgaccaccagcgggagcaggagctgagagagtggatcgagggggtgacaggccgtcgcatcggcaacaacttcatggacggcctcaaagatggcatcattctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcagatgggcaccaacaagtttgccagccagcagggcatgacggcctatggcacccggcgccacctctacgaccccaagctgggcacagaccagcctctggaccaggcgaccatcagcctgcagatgggcaccaacaaaggagccagccaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcggggggcccattggggggaaggggaccctccgctctgtagtgctacagggtccaacatagagccgggtgtccccaacagcgcccaaaggacgcactgagcaacgctattccagctgtccccccactccctcacaagtgggtacccccaggaccagaagctcccccagcaaagcccccagagcccaggctcggcctgcccccaccccattcccgcagtgggagcaaactgcatgcccagagacccagcggacacacgcggtttggtttgcagcgactggcatactatgtggatgtgacagtggcgtttgtaatgagagcactttcttttttttctatttcactggagcacaataaatggctgtaaaatct

SEQ ID NO: 113700 - DNA, 525 bp, Homo sapiens
  Payload ID: 2213
  Gene Symbol: CNN1
  Gene Name: calponin 1, basic, smooth muscle
  ENST ID: ENST00000592338
  CDS Start-End: 1-525
attcatcaataagctgcagccaggctccgtgaagaagatcaatgagtcaacccaaaattggcaccagctggagaacatcggcaacttcatcaaggccatcaccaagtatggggtgaagccccacgacatttttgaggccaacgacctgtttgagaacaccaaccatacacaggtgcagtccaccctcctggctttggccagcatggcgaagacgaaaggaaacaaggtgaacgtgggagtgaagtacgcagagaagcaggagcggaaattcgagccggggaagctaagagaagggcggaacatcattgggctgcaggctggcatgactgcgccagggaccaagcggcagatcttcgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgccca

SEQ ID NO: 113701 - DNA, 549 bp, Homo sapiens
  Payload ID: 2213
  Gene Symbol: CNN1
  Gene Name: calponin 1, basic, smooth muscle
  ENST ID: ENST00000585869
  CDS Start-End: 191-549
acagacgggggagggcgagccaggagcgagataagacctagacaaggatggaggggcagggagaggagacagagccccaccacccccaccccaggcaggaaacctggagacagagaaagacctagagaggcagatatacaagacccaggagccctacccctggccagacagggactagccacctagagagatggggacccaagactgggccaagaaaagacagcgctggggaagagagagacagaggagtcggggggataagagggagagagacatacagacgtgcaaggggtgggggctaagacagagacaagcccccaccactaaccagagacagagccctggagctgaagacctgggggacacggagagacagagatgtatgaccagcactcctctgcaagccagcacccagggacacctccttagacatccttcttcccttcctgagctggcccagaagtatgaccaccagcgggagcaggagctgagagagtggatcgagggggtgacaggccgtcgcatcggcaacaacttcatggacggcct

SEQ ID NO: 113702 - DNA, 512 bp, Homo sapiens
  Payload ID: 2213
  Gene Symbol: CNN1
  Gene Name: calponin 1, basic, smooth muscle
  ENST ID: ENST00000587087
  CDS Start-End: 1-348
ctttgcgaattcatcaataagctgcagccaggctccgtgaagaagatcaatgagtcaacccaaaattggcaccagctggagaacatcggcaacttcatcaaggccatcaccaagtatggggtgaagccccacgacatttttgagccggggctgggcatggagcactgcgacacgctcaatgtcagcctgcagatgggcagcaacaagggcgcctcgcagcggggcatgacggtgtatgggctgccacgccaggtctacgaccccaagtactgtctgactcccgagtacccagagctgggtgagcccgcccacaaccaccacgcacacaactactacaattccgcctagggccacaaggccttccctgttttccccccaagggaggctgctgctgctcttggctggacccagccaggcccagccgaccccctctccctgcatggcatcctccagcccctgtagaactcaacctctacagggttagagtttggagagagcagactggcgggggg

SEQ ID NO: 113703 - DNA, 2179 bp, Homo sapiens
  Payload ID: 2214
  Gene Symbol: CNN2
  Gene Name: calponin 2
  Uniprot ID: Q99439
  ENST ID: ENST00000263097
  CDS Start-End: 82-1011
cgcgtcccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccagcccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaa

SEQ ID NO: 113704 - DNA, 2033 bp, Homo sapiens
  Payload ID: 2214
  Gene Symbol: CNN2
  Gene Name: calponin 2
  Uniprot ID: Q99439
  ENST ID: ENST00000348419
  CDS Start-End: 53-865
tcccgtcccgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccagcccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaa

SEQ ID NO: 113705 - DNA, 623 bp, Homo sapiens
  Payload ID: 2214
  Gene Symbol: CNN2
  Gene Name: calponin 2
  ENST ID: ENST00000562075
  CDS Start-End: 161-623
ctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtggggctcgcccgggtgcccccgactcctctccctgcccctctacaccctgtggtctcggcccctccctggggccacctccagcttctctccccactctcagtctcagcccctt

SEQ ID NO: 113706 - DNA, 2194 bp, Homo sapiens
  Payload ID: 2214
  Gene Symbol: CNN2
  Gene Name: calponin 2
  ENST ID: ENST00000562958
  CDS Start-End: 34-1026
gtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaagggcctagatctagggtccctggctgccctctgctggtactcccggcccctttccctcacccaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccagcccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaa

SEQ ID NO: 113707 - DNA, 2109 bp, Homo sapiens
  Payload ID: 2214
  Gene Symbol: CNN2
  Gene Name: calponin 2
  ENST ID: ENST00000565096
  CDS Start-End: 45-941
cgtcccgtcctgtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaatacattttttcccccaggggtggggcaaggacagtggagagagtgctaggaaatgagtcccctgggaaaggggaccgggccgtgatgttaaatatctccggctcccaagtgactggatttgcctaggaccttcagaccaacagacttcagaccctcagacctgccccggggccaggtggagaaagtgagggccgtacaaggaagtgaaattctgagttgttggggctaagcctgaccccctctccatgctccccgccccaacccactctggcctcagtagatttttttttcagttgtggttgttgcccaggctggagtgcagtggcgccatcttggctcactgcacctccaccttccgggctcaagcgattctccagcctcagcctcctgagtagctaggactgcaggtgctccaccacgcccggctaatttttgtatttttagtagagatggggtttccccatgttggccaggctggtctcgaactcctggcctcaggtgtgatccgcccgcctccgcctccccaagcgctgagattacaggtgtgagccaccgtgcccagcccctcagtaggttttaaggagcccccagccctcctcccttctgggcccgaccagcttatactgctccatcttccccggccacatgccccgccaagtactgcacagggaccccccacccaggggacctgctccgtgagataatgtgaaatacgactgtggaccaaacgcaataaaacctctgtttgtacgaagagaa

SEQ ID NO: 113708 - DNA, 1332 bp, Homo sapiens
  Payload ID: 2214
  Gene Symbol: CNN2
  Gene Name: calponin 2
  ENST ID: ENST00000568865
  CDS Start-End: 1-657
ctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggatctcactctgttgtccaggctggagtgcagtggcacgatctcggctcactgcaacctctgcctcccgggttcaagagattctccttcctgcctcagcctcccgagtagctgggactacaggtgggcatgacggctcccgggacccggcggcacatctatgataccaagctgggaaccgacaagtgtgacaactcctccatgtccctgcagatgggctacacgcagggcgccaaccagagcggccaggtcttcggcctgggccggcagatatatgaccccaagtactgcccgcaaggcacagtggccgatggggctccctcgggcaccggcgactgcccggacccgggggaggtccctgaatatcccccttactaccaggaggaggccggctactgaggctcccagcacgctctctccccacatcgtctgcccatctgggtttttgggtttttctgtgttttcatcttttttttttttttcttaacccgttcagtgctgccagtcaaccaagggtctgtgagtgtcagcgtgggatcaggcagcagagcttttttcccctttgccttgatccttcgcaaggctgagccactgggctgtgggggaaggggtcaaggccatatcccaatacgtgtagggcgagggtccctgctggcacattcaggctgtgctgggaagaagagacctgggcttggaaggaaccggtccccgacggtttctgcttgcctcgcctcttcccccttttgtcagctgagcagtttgtggtttctatgcccgcaagtttcaggaagtattcacaaaagaaaaa

SEQ ID NO: 113709 - DNA, 731 bp, Homo sapiens
  Payload ID: 2214
  Gene Symbol: CNN2
  Gene Name: calponin 2
  ENST ID: ENST00000569352
  CDS Start-End: 34-480
gtgcggccccgtcccgccgcccgcccgccagccatgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggtgaggcccagagaggggcagccacctgcccagagtcacacagcgaggtggatgtagctgctgcattcactcgtttgcaaatttctgtttgtttatttttgagtcggagtctcactctgtcactcaggctggagtgcaatggcgtgatctcagctcactgcaacctccaactcccaggttcaagcgattcttctgcctcagtctcccgagtagctgggattacaggcgtgagccagtgcacccagtgaaggtcccctcttctctccaccatgacctgctccacccctccttcctctccaggtgggcat

SEQ ID NO: 113710 - DNA, 307 bp, Homo sapiens
  Payload ID: 2214
  Gene Symbol: CNN2
  Gene Name: calponin 2
  ENST ID: ENST00000607102
  CDS Start-End: 1-307
ctcgtacgggctgtcggccgaggtcaagaaccggatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtggggctcgcccgggtgcccccgactcctctccctgcccctctacaccctgtggtctcggcccctccctggggccacctccagcttctctccccactctcagtctcagccccttccctagaccac

SEQ ID NO: 113711 - DNA, 563 bp, Homo sapiens
  Payload ID: 2214
  Gene Symbol: CNN2
  Gene Name: calponin 2
  ENST ID: ENST00000562015
  CDS Start-End: 364-563
cccaaccccgcgccagcccggcggtcccgtcccgtcccgtcctgtgcggccccgtcccgccgcccgcccgccagccatgagctccacgcagttcaacaagggcccctcgtacgggctgtcggccgaggtcaagaaccgggggtagttgggtctgacttcgtcccctcgccatggccccaggacccccacgtgtgaagcccctggcgcccactcaaccttcgagaaggtccgttcaagctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaa

SEQ ID NO: 113712 - DNA, 828 bp, Homo sapiens
  Payload ID: 2214
  Gene Symbol: CNN2
  Gene Name: calponin 2
  ENST ID: ENST00000566695
  CDS Start-End: 255-828
gggacctccaggccgctctatctgctgttgccctggagtccccggccccaccctctgcagagcttctgtggggttcctgctgggggtgcccccagcccagctcagtctcgtgccctttgctccaccagctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggtgtctcttctcgccctggcggggaaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaaggcatctctatgaccccaagaaccatatcctgccccccatggaccactcgaccatcagcctccagatgggcacgaacaagtgtgccagccaggtgggcatgacggctcccgggacccggcggcacatctatgataccaagctgggaaccgacaagtgtgacaactcctccatgtccctgcagatgggctacacgcagggcg

SEQ ID NO: 113713 - DNA, 537 bp, Homo sapiens
  Payload ID: 2214
  Gene Symbol: CNN2
  Gene Name: calponin 2
  ENST ID: ENST00000606983
  CDS Start-End: 1-537
atgagctccacgcagttcaacaagggcccctcgtacgggctgtcggccgaggtcaagaaccggctcctgtccaaatatgacccccagaaggaggcagagctccgcacctggatcgagggactcaccggcctctccatcggccccgacttccagaagggcctgaaggatggaactatcttatgcacactcatgaacaagctacagccgggctccgtccccaagatcaaccgctccatgcagaactggcaccagctagaaaacctgtccaacttcatcaaggccatggtcagctacggcatgaaccctgtggacctgttcgaggccaacgacctgtttgagagtgggaacatgacgcaggtgcaggccaagactaaggggctgcagagcggggtggacattggcgtcaagtactcggagaagcaggagcggaatttcgacgatgccaccatgaaggctggccagtgcgtcatcgggctgcagatgggcaccaacaaatgcgccagccagtcgggcatgactgcctacggcacgagaagg

SEQ ID NO: 113714 - DNA, 2165 bp, Homo sapiens
  Payload ID: 2215
  Gene Symbol: CNN3
  Gene Name: calponin 3, acidic
  Uniprot ID: Q15417
  ENST ID: ENST00000370206
  CDS Start-End: 385-1374
cgggagggaaagcggcccccgcggcccttcaattggccgcaccgcccctcggcgcagaggcgggaggaggcggccctccattggtcgggcccggcggccaatcctcgaaggcccaggcggaggcgggggcggcctgtggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaa

SEQ ID NO: 113715 - DNA, 1974 bp, Homo sapiens
  Payload ID: 2215
  Gene Symbol: CNN3
  Gene Name: calponin 3, acidic
  Uniprot ID: Q15417
  ENST ID: ENST00000394202
  CDS Start-End: 330-1181
agaggcgggaggaggcggccctccattggtcgggcccggcggccaatcctcgaaggcccaggcggaggcgggggcggcctgtggggaaccgaggtgcgggcggcgagcgaggcagccgggtgcttcgcagcggagctcgaggctctgtagcacccagttggacccagtcgcccaggcaccgcccgcgccccgcggccgtctcctgcgcctcccagaggagggagttcgagcatcccccgcggcggccactcctcggggccaggagcggggaagcgaagtgcgagagaccccggaccccagcgctgtctcttcccgccgcccgaaccaccatgacccacttcaacaagggcccttcctatgggctctcggccgaagtcaagaacaagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcaggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaacc

SEQ ID NO: 113716 - DNA, 792 bp, Homo sapiens
  Payload ID: 2215
  Gene Symbol: CNN3
  Gene Name: calponin 3, acidic
  ENST ID: ENST00000415017
  CDS Start-End: 236-792
cacaaaggagggctgcctgtggtttaattcccattaacctcccgggagcccaagcatgtcaggattgccaccgcaccgtccgaccgctggtggaaggcactggcattgtcagagctggaacatcccggggctgcgggggtaggcggtgtgaagcgaattatgtaaagagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagaga

SEQ ID NO: 113717 - DNA, 1902 bp, Homo sapiens
  Payload ID: 2215
  Gene Symbol: CNN3
  Gene Name: calponin 3, acidic
  Uniprot ID: Q15417
  ENST ID: ENST00000545882
  CDS Start-End: 243-1109
aaagcgccacaaaggagggctgcctgtggtttaattcccattaacctcccgggagcccaagcatgtcaggattgccaccgcaccgtccgaccgctggtggaaggcactggcattgtcagagctggaacatcccggggctgcgggggtaggcggtgtgaagcgaattatgtaaagagattgcttccaagtatgatcatcaggcagaagaagatcttcgcaattggatagaagaggtgacaggcatgagcattggccccaacttccagctgggcttaaaggatggcatcatcctctgcgaacttataaacaagctacagccaggctcagtgaagaaggtcaacgagtcctcactgaactggcctcagttggagaatattggcaactttattaaagctattcaggcttatggtatgaagccacatgacatattcgaagcaaatgatctttttgagaatggaaacatgacccaggttcagactactctggtggctctagcaggtctggctaaaacaaaaggattccatacaaccattgacattggagttaagtatgcagaaaaacaaacaagacgttttgatgaaggaaaattaaaagctggccaaagtgtaattggtctgcagatgggaaccaacaaatgtgccagccaggcaggtatgacagcttacgggactaggaggcatctttatgatcccaaaatgcaaactgacaaaccttttgaccagaccacaattagtctgcagatgggcactaataaaggagccagccaggcagggatgttagcaccaggtaccagaagagacatctatgatcagaagctaacattacagccggtggacaactcgacaatttccctacagatgggtaccaacaaagttgcttcccagaaaggaatgagtgtgtatgggcttgggcggcaagtatatgatcccaaatactgtgctgctcctacagaacctgtcattcacaacggaagccaaggaacaggaacaaatggttcggaaatcagtgatagtgattatcaggcagaataccctgatgagtatcatggcgagtaccaggatgactaccccagagattaccaatatagcgaccaaggcattgattattagatccacacagaaggagctcagtatttagtcctttgtttttattcagtgagaaccaagctagccttgagtaatttttatcttgtcttcctaaaacactattaagcttattgtacttttaagaaaaattgccttacgtacattcctttttcctttttctgcctcttccctcaatagttgccttttagtgctgtaatagttaaatcctacagcataatcaataactcgcatatgaagtaaaaaggaatactgtgaaaggggagtactcttgtacagccagttcttttatgcaaaaatctatgcatttttacaatcttatattaaactggtattttcaaacaataggaaactttttttttttttttttttttttacagtttagtgtatctggtttctacatggaagactaaactcatgcttattgctaaatgtggtctttgccaactaaatttaagatgcagcattttagaaatttacatatcaatgtttctacagtattgtttgctaatttttaaataaagtcatgatcagtgtgcatttgtgattatatgtgtactcattctcttacctagcgaacaagatcttttcagagtggtgtttctaaaagagcatgtacaaaagtggcctgtggacatttaggcctgggtgatgcatttgctcttcctgtttgtgccaatgtatcaatgtagagttgctctgttttcttcaactgtatttattgctgcatttctcagcataaacttatcccattgtattttttataaataaatattttttttgaactttcatatgaacc

SEQ ID NO: 113718 - DNA, 1903 bp, Homo sapiens
  Payload ID: 2216
  Gene Symbol: CALR
  Gene Name: calreticulin
  Uniprot ID: P27797
  ENST ID: ENST00000316448
  CDS Start-End: 74-1327
ccgtccgtactgcagagccgctgccggagggtcgttttaaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtttgcagacaagccaggatgcacgcttttatgctctgtcggccagtttcgagcctttcagcaacaaaggccagacgctggtggtgcagttcacggtgaaacatgagcagaacatcgactgtgggggcggctatgtgaagctgtttcctaatagtttggaccagacagacatgcacggagactcagaatacaacatcatgtttggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcttaaggaggaggaagaagacaagaaacgcaaagaggaggaggaggcagaggacaaggaggatgatgaggacaaagatgaggatgaggaggatgaggaggacaaggaggaagatgaggaggaagatgtccccggccaggccaaggacgagctgtagagaggcctgcctccagggctggactgaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctc

SEQ ID NO: 113719 - DNA, 776 bp, Homo sapiens
  Payload ID: 2216
  Gene Symbol: CALR
  Gene Name: calreticulin
  ENST ID: ENST00000588454
  CDS Start-End: 36-776
aaagggcccgcgcgttgccgccccctcggcccgccatgctgctatccgtgccgctgctgctcggcctcctcggcctggccgtcgccgagcctgccgtctacttcaaggagcagtttctggacggagacgggtggacttcccgctggatcgaatccaaacacaagtcagattttggcaaattcgttctcagttccggcaagttctacggtgacgaggagaaagataaaggtcccgacatctgtggccctggcaccaagaaggttcatgtcatcttcaactacaagggcaagaacgtgctgatcaacaaggacatccgttgcaaggatgatgagtttacacacctgtacacactgattgtgcggccagacaacacctatgaggtgaagattgacaacagccaggtggagtccggctccttggaagacgattgggacttcctgccacccaagaagataaaggatcctgatgcttcaaaaccggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggc

SEQ ID NO: 113720 - DNA, 913 bp, Homo sapiens
  Payload ID: 2216
  Gene Symbol: CALR
  Gene Name: calreticulin
  ENST ID: ENST00000586760
  CDS Start-End: 1-491
cggaagactgggatgagcgggccaagatcgatgatcccacagactccaagcctgaggactgggacaagcccgagcatatccctgaccctgatgctaagaagcccgaggactgggatgaagagatggacggagagtgggaacccccagtgattcagaaccctgagtacaagggtgagtggaagccccggcagatcgacaacccagattacaagggcacttggatccacccagaaattgacaaccccgagtattctcccgatcccagtatctatgcctatgataactttggcgtgctgggcctggacctctggcaggtcaagtctggcaccatctttgacaacttcctcatcaccaacgatgaggcatacgctgaggagtttggcaacgagacgtggggcgtaacaaaggcagcagagaaacaaatgaaggacaaacaggacgaggagcagaggcctgagcgctcctgccgcagagctggccgcgccaaataatgtctctgtgagactcgagaactttcatttttttccaggctggttcggatttggggtggattttggttttgttcccctcctccactctcccccaccccctccccgcccttttttttttttttttttaaactggtattttatctttgattctccttcagccctcacccctggttctcatctttcttgatcaacatcttttcttgcctctgtccccttctctcatctcttagctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttct

SEQ ID NO: 113721 - DNA, 394 bp, Homo sapiens
  Payload ID: 2216
  Gene Symbol: CALR
  Gene Name: calreticulin
  ENST ID: ENST00000586967
  CDS Start-End: 1-41
aggaggaagatgtccccggccaggccaaggacgagctgtagagaggcctgcctccagggctggactgaggcctgagcgctcctgccgcagagctggccgcgccaaataatgtctctctcccctccaacctggggggcagtggtgtggagaagccacaggcctgagatttcatctgctctccttcctggagcccagaggagggcagcagaagggggtggtgtctccaaccccccagcactgaggaagaacggggctcttctcatttcacccctccctttctcccctgcccccaggactgggccacttctgggtggggcagtgggtcccagattggctcacactgagaatgtaagaactacaaacaaaatttctattaaattaaattttgtgtctc

SEQ ID NO: 113722 - DNA, 1292 bp, Homo sapiens
  Payload ID: 2217
  Gene Symbol: CALR3
  Gene Name: calreticulin 3
  Uniprot ID: Q96L12
  ENST ID: ENST00000269881
  CDS Start-End: 64-1218
agagccgcagagagagctgggagctaaggggtggcggcgaccggaagcgcagtgcacacccccatggcccgggctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggtctgcaaaccactcagaatggccgattctatgccatctctgcacgcttcaaaccgttcagcaataaagggaaaactctggttattcagtacacagtaaaacatgagcagaagatggactgtggagggggctacattaaggtctttcctgcagacattgaccagaagaacctgaatggaaaatcgcagtactatattatgtttggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaatcgaaggattgggaacagactaaagacaacaaagcccaggactgggagaagcattttctggacgccagcaccagcaagcagagcgactggaacggtgacctggatggggactggccagcgccgatgctccagaagcccccgtaccaggatggcctgaaaccagaaggtattcataaagacgtctggctccaccgtaagatgaagaataccgactatttgacgcagtatgacctctcagaatttgagaacattggtgccattggcctggagctttggcaggtgagatctggaaccatttttgataactttctgatcacagatgatgaagagtacgcagataattttggcaaggccacctggggcgaaaccaagggtccagaaagggagatggatgccatacaggccaaggaggaaatgaagaaggcccgcgaggaagaggaggaagagctgctgtcgggaaaaattaacaggcacgaacattacttcaatcaatttcacagaaggaatgaactttagtgatccccattggatataaggatgactggtaaaatctcattgctactttaatctatgtttcaaactcaaatgtc

SEQ ID NO: 113723 - DNA, 425 bp, Homo sapiens
  Payload ID: 2217
  Gene Symbol: CALR3
  Gene Name: calreticulin 3
  ENST ID: ENST00000600762
  CDS Start-End: 1-425
ctttggtccagctctgggccatatgcatgctgcgagtggcgctggctaccgtctatttccaagaggaatttctagacggagagcattggagaaaccgatggttgcagtccaccaatgactcccgatttgggcattttagactttcgtcgggcaagttttatggtcataaagagaaagataaaggacccgatatttgtggatttgatatcaagaaagttcatgttattttacatttcaagaataagtatcacgaaaacaagaaactgatcaggtgtaaggttgatggcttcacacacctgtacactctaattttaagaccagatctttcttatgatgtgaaaattgatggtcagtcaattgaatccggcagcatagagtacgactggaacttaacatcactcaagaaggaaacgtccccggcagaa

SEQ ID NO: 113724 - DNA, 1897 bp, Homo sapiens
  Payload ID: 2218
  Gene Symbol: CASQ1
  Gene Name: calsequestrin 1 (fast-twitch, skeletal muscle)
  Uniprot ID: P31415
  ENST ID: ENST00000368078
  CDS Start-End: 197-1387
acctgaccctttttcccttggctctgtcggcagtttctccaggacccagcagtgccctctgtccactgctctgggccattccccaatcccccctcccacttgagcccctaactcagaatctgggacccaggggcccctccctaccccagctaacctcttctggaccaggagagccaacccagatcccactacctccatgagtgctacagacaggatggggcccagagctgtgccgggtctgcggctggcactgctgttgctgctggtgctagggacacccaagtcaggggtacaggggcaggaagggctggacttccctgagtacgatggtgtggaccgtgtgatcaatgtcaatgcaaagaactacaagaatgtgttcaagaagtatgaggtgctggcactcctctaccatgaaccccccgaggatgacaaggcctcacaaagacaatttgagatggaggagctgatcctggagttagcagcccaagtcctagaagacaagggtgttggcttcgggctggtagactctgagaaggatgcagctgtggccaagaaactaggcctaactgaagtggacagcatgtatgtattcaagggagatgaagtcattgagtacgatggcgagttttctgctgacaccatcgtggagtttctgcttgatgtcctagaggaccctgtggaattgattgaaggtgaacgagagctgcaggcgtttgagaatattgaggatgagatcaaactcattggctacttcaagagcaaagactcagagcattacaaagccttcgaggatgcagctgaggagtttcatccctacatccccttcttcgccaccttcgacagcaaggtggcaaagaagctgaccctgaagctgaatgagattgatttctacgaggccttcatggaagagcctgtgaccatcccagacaagcccaatagcgaagaggagattgtcaacttcgtggaggagcacaggagatcaaccctgaggaaactgaagccggagagtatgtatgagacctgggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaactggggtctatatgctgggtgctgagacactgatccccctcatttgatgagcaaatgagctacttttccctagacaccaggccagctctctcttatctgacttctgtttcttatcccataacttacttgtatctattatgtgtctcttccatcactctccatactctttcttgtgattctcctctagccatatatatgggccccatctctgttctgttccctccatctatgcacagctttcccccactctctctaatcctgtatctttctgactgtcctgtccttggccagaaggaagggagaatactgtgtttgggactgtatctcagcaatcacttgttaatgtatttgggtcaaatgagaggcctcaataaagacatctggggcagcatgaa

SEQ ID NO: 113725 - DNA, 595 bp, Homo sapiens
  Payload ID: 2218
  Gene Symbol: CASQ1
  Gene Name: calsequestrin 1 (fast-twitch, skeletal muscle)
  ENST ID: ENST00000467691
  CDS Start-End: 125-478
acaagaatatatatggccaggcgcagtggctcacgcctgtaatcccagcactttgggaggctgaggcaggcagatcatctgaggtcaggagtttgagaccagcccgatcaacaaggaggatgatatggatggaatccacattgtggccttcgcagaggaagctgatcctgatggtttcgagttcttagagactctcaaggctgtggcccaagataacactgaaaacccagatcttagcatcatctggattgaccctgatgacttccccctgctggtcccatactgggagaagacgtttgacatcgacttgtcagccccacaaataggagtcgtcaatgttactgatgcggatagcgtatggatggaaatggacgatgaggaggacctgccttctgctgaggagctggaggactggctggaggatgtcctggagggcgagatcaacacagaggacgatgacgatgatgatgatgactagttgctatggcaaccatctttcagccccactggtcttttcatgctctctcctgccttcccttgtccttccctgagttcctccagggagactaggttattctctgccatagagctaact

SEQ ID NO: 113726 - DNA, 2674 bp, Homo sapiens
  Payload ID: 2219
  Gene Symbol: CASQ2
  Gene Name: calsequestrin 2 (cardiac muscle)
  Uniprot ID: O14958
  ENST ID: ENST00000261448
  CDS Start-End: 241-1440
tgcgtgcgtgcgtgcgtgcgtgtgtgtgtgtgtgtgcctctgctctttgtcctgagcccacgattccagagctggctggacccaaggaggtgaagagtcacttttcagccccaggaagggcaaagaagagagaaaatcagcctgtctgctctctccttggctcaacaaggcctctaacagtcttctgtcctctattctgcacacagcatatttgggaacgagaaacaaaagttttcccaaatgaagagaactcacttgtttattgtggggatttattttctgtcctcttgcagggcagaagaggggcttaatttccccacatatgatgggaaggaccgagtggtaagtctttccgagaagaacttcaagcaggttttaaagaaatatgacttgctttgcctctactaccatgagccggtgtcttcagataaggtcacgcaaaaacagttccaactgaaagaaatcgtgcttgagcttgtggcccaggtccttgaacataaagctataggctttgtgatggtggatgccaagaaagaagccaagcttgccaagaaactgggttttgatgaagaaggaagcctgtatattcttaagggtgatcgcacaatagagtttgatggcgagtttgcagctgatgtcttggtggagttcctcttggatctaattgaagacccagtggagatcatcagcagcaaactggaagtccaagccttcgaacgcattgaagactacatcaaactcattggctttttcaagagtgaggactcagaatactacaaggcttttgaagaagcagctgaacacttccagccttacatcaaattctttgccacctttgacaaaggggttgcaaagaaattatctttgaagatgaatgaggttgacttctatgagccatttatggatgagcccattgccatccccaacaaaccttacacagaagaggagctggtggagtttgtgaaggaacaccaaagacccactctacgtcgcctgcgcccagaagaaatgtttgaaacatgggaagatgatttgaatgggatccacattgtggcctttgcagagaagagtgatccagatggctacgaattcctggagatcctgaaacaggttgcccgggacaatactgacaaccccgatctgagcatcctgtggatcgacccggacgactttcctctgctcgttgcctactgggagaagactttcaagattgacctattcaggccacagattggggtggtgaatgtcacagatgctgacagtgtctggatggagattccagatgatgacgatcttccaactgctgaggagctggaggactggattgaggatgtgctttctggaaagataaacactgaagatgatgatgaagatgatgatgatgatgataattctgatgaagaggataatgatgacagtgatgacgatgatgatgaatagcccaactccaaacaattctgatgaaaacaaaatcacagcacccactaccatacagacagcacaaggtggcagcaagcaattctgccccacacccagccagctcctttcccttttccatcatctcttttcccactccctttgcgtcaggagcagcatcattcagcaaatgccttttcaaatgcagcaatcccacttagcagggacaggagaaaaattattcccatgttgactgtcttgactgtcacggaacagatcttgttctttgctggaccatcaagggtcatggcagtgcctgaacatggcagtctagggtgaacaatcccctaacacaagtttacttgtctttgattatgacagtaacaaaattgacagctttctaactcacaggcatagagtgaccttttaatcagagcccagggaagacacatgattaatgatttagctccctccatacctcgaacatcagttgggatccctcctccagccaagatgatccttcttagagaaggctcagccttggaagcaaacttataaatcatattctcatggctttgttaaacttatttcaagtgatggtcattcatatcactatgaacttggatattcaagcctttggatggctatggagagggcttgaaatgtgtacaggtgtcaccatcatttctagtatattaggaaactgggatgggaggttgatttgctctctaaacttccctctagttggcaagtctcacatattcatcagcaggagtggagggtgggggaaaactagaaagatgaaaacttttacatttttctgatgggttcatgtctctgattgggtcagctggcttcctagcctaagctgggatctgaataccccttctctgtagctgctagtgagccttcccatttagattaaagattgctttatccagcagtcaattaactctccagttatcagtactcccacaattggccagggcaacaataattggagttcatactgatgccctgaggcactgaaaaaaaaaaaaatcccaaagtgccttctgagctgtctaaaagttacattgtgcttggtagatttagtgttaagtgtgcagtataattttctaatttattttctcaatcttttagcacatgtgtaagacactgtgcaaattttttgaaaatagagcaatactttttgtggaatactagctaactaattctgtcattaaactcatattttgaaaatattcagacaatgttg

SEQ ID NO: 113727 - DNA, 4647 bp, Homo sapiens
  Payload ID: 2220
  Gene Symbol: CLSTN1
  Gene Name: calsyntenin 1
  Uniprot ID: O94985
  ENST ID: ENST00000361311
  CDS Start-End: 252-3167
gagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctagccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 113728 - DNA, 5221 bp, Homo sapiens
  Payload ID: 2220
  Gene Symbol: CLSTN1
  Gene Name: calsyntenin 1
  Uniprot ID: O94985
  ENST ID: ENST00000377298
  CDS Start-End: 794-3739
gtctcctggaccccctttcgtgacccctctcaacacctctactggggagacgaggaccccgaggttctggggggcgacgcgacctgcccgaagtgacaagggtcctgggccgcactgctccgccggggtctgcgctcctcggcggagcgggtgggaaggatgagtcctcggggtggagaaggaggagcgggtccccgggtaccgctcacccggccttaggagcccgggagcgcgcgtagggacgcggagttgaggctctccatctgcggccagggaaagggatacagtcccccgggcccctcccggccgctcggaacccaccccaggcgcgtccccgcgggcgcgcgctccaggcggggccgacgggctcggaggcgcgcgcccgctgccgggtccgccgcgcgcgctccctccgctcctctcccccgcccctcccgggcccgcgcgctcccagggtccgccgcgcgcgcgcctcgcgtcgctccccatccccgcccctcccgccgccaccccgcccccggccgggtaccctcgccggacccgagagagagcgccgccgccatcttagttgctgccgctgccttcagcaagacgctgctctgaggcggggagggcgccgcgtcctgagcgcgcggcccagcgtcacggcggcggcggcggcggctcctccttggacccccggagctccccgcgccgcggagcagctagccccaggcccctagagccccgagagctccgagagctccgctcggcgtcccgcgcgcctccctgccgctcccgccccgggctggcgatgctgcgccgccccgctcccgcgctggccccggccgcccggctgctgctggccgggctgctgtgcggcggcggggtctgggccgcgcgagttaacaagcacaagccctggctggagcccacctaccacggcatagtcacagagaacgacaacaccgtgctcctcgaccccccactgatcgcgctggataaagatgcgcctctgcgatttgcagagagttttgaggtgacagtcaccaaagaaggtgagatttgtggatttaaaattcacgggcagaatgtcccctttgatgcagtggtagtggataaatccactggtgagggagtcattcgctccaaagagaaactggactgtgagctgcagaaagactattcattcaccatccaggcctatgattgtgggaagggacctgatggcaccaacgtgaaaaagtctcataaagcaactgttcatattcaggtgaacgacgtgaatgagtacgcgcccgtgttcaaggagaagtcctacaaagccacggtcatcgaggggaagcagtacgacagcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaagagttttcaggagttgaaaatgacaatgaaactgagcctgtgactgtggcctctgcaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaactaa

SEQ ID NO: 113729 - DNA, 3829 bp, Homo sapiens
  Payload ID: 2220
  Gene Symbol: CLSTN1
  Gene Name: calsyntenin 1
  ENST ID: ENST00000435891
  CDS Start-End: 1-2349
agcattttgagggtggaggccgtggatgccgactgctcccctcagttcagccagatttgcagctacgaaatcatcactccagacgtgccctttactgttgacaaagatggttatataaaaaacacagagaaattaaactacgggaaagaacatcaatataagctgaccgtcactgcctatgactgtgggaagaaaagagccacagaagatgttttggtgaagatcagcattaagcccacctgcacccctgggtggcaaggatggaacaacaggattgagtatgagccgggcaccggcgcgttggccgtctttccaaatatccacctggagacatgtgacgagccagtcgcctcagtacaggccacagtggagctagaaaccagccacatagggaaaggctgcgaccgagacacctactcagagaagtccctccaccggctctgtggtgcggccgcgggcactgccgagctgctgccatccccgagtggatccctcaactggaccatgggcctgcccaccgacaatggccacgacagcgaccaggtgtttgagttcaacggcacccaggcagtgaggatcccggatggcgtcgtgtcggtcagccccaaagagccgttcaccatctcggtgtggatgagacatgggccattcggcaggaagaaggagacaattctttgcagttctgataaaacagatatgaatcggcaccactactccctctatgtccacgggtgccggctgatcttcctcttccgtcaggatccttctgaggagaagaaatacagacctgcagagttccactggaagttgaatcaggtctgtgatgaggaatggcaccactacgtcctcaatgtagaattcccgagtgtgactctctatgtggatggcacgtcccacgagcccttctctgtgactgaggattacccgctccatccatccaagatagaaactcagctcgtggtgggggcttgctggcaaggtggcgacctgcacatgacccagtttttccgaggcaatctggctggcttaactctccgttccgggaaactcgcggataagaaggtgatcgactgtctgtatacctgcaaggaggggctggacctgcaggtcctcgaagacagtggcagaggcgtgcagatccaagcacaccccagccagttggtattgaccttggagggagaagacctcggggaattggataaggccatgcagcacatctcgtacctgaactcccggcagttccccacgcccggaattcgcagactcaaaatcaccagcacaatcaagtgttttaacgaggccacctgcatttcggtccccccggtagatggctacgtgatggttttacagcccgaggagcccaagatcagcctgagtggcgtccaccattttgcccgagcagcttctgaatttgaaagctcagaaggggtgttccttttccctgagcttcgcatcatcagcaccatcacgagagaagtggagcctgaaggggacggggctgaggaccccacagttcaagaatcactggtgtccgaggagatcgtgcacgacctggatacctgtgaggtcacggtggagggagaggagctgaaccacgagcaggagagcctggaggtggacatggcccgcctgcagcagaagggcattgaagtgagcagctctgaactgggcatgaccttcacaggcgtggacaccatggccagctacgaggaggttttgcacctgctgcgctatcggaactggcatgccaggtccttgcttgaccggaagtttaagctcatctgctcagagctgaatggccgctacatcagcaacgaatttaaggtggaggtgaatgtaatccacacggccaaccccatggaacacgccaaccacatggctgcccagccacagttcgtgcacccggaacaccgctcctttgttgacctgtcaggccacaacctggccaacccccacccgttcgcagtcgtccccagcactgcgacagttgtgatcgtggtgtgcgtcagcttcctggtgttcatgattatcctgggggtatttcggatccgggccgcacatcggcggaccatgcgggatcaggacaccgggaaggagaacgagatggactgggacgactctgccctgaccatcaccgtcaaccccatggagacctatgaggaccagcacagcagtgaggaggaggaggaagaggaagaggaagaggaaagcgaggacggcgaagaagaggatgacatcaccagcgccgagtcggagagcagcgaggaggaggagggggagcagggcgacccccagaacgcaacccggcagcagcagctggagtgggatgactccaccctcagctactgacccgtgcccccggccacctcggtttctgctttcgaagactctgctgccatccgttctcccagtcccaagggtccacgatgtacaaagtcatttcggccagtaggtgtgcagacccctccccgccacgatcgtcgctgtgcttggtgtgtaggaccctaggctccccgcccaccctctgcctggtcgcgctcttcagtcccacgaggagctgacacgtcctctctggccgccatccggctcgcacaggggcctcccagcgcctcaggccccgcgtttgtgtctggagtctccccccggggagaggacactggcccctcgcactccagaaaagccatgccagctgggctcgttgacaaagggtaaaacatgctcactcccacccggtaatcatttttttctttttttaaaaaaagtttttattttttccaaactagtgcatgtataaataatggcaggatggggggtactgtgtagatgattaactgactttttaatattttgtaaataaatcggattccttgtgtcctttgtgctagtgtaacccgggactggaatgtaaagtgaagttcggagctctgagcacgggctcttcccgccgggtcctccctccccagaccccagagggagaggcccaccccgcccagccccgccccagcccctgctcaggtctgagtatggctgggagtcgggggccacaggcctctagctgtgctgctcaagagactggatcagggtagctacaagtggccgggccttgcctttgggattctacctgttcctaatttggtgtggggtgcggggtccctggccccttttccacactcctcctccgacagcagctccctgggcagtggcctggtctcaccgtgtgcagccttgtggtttatgcttaaatgtacattttcctgctggtaaaaggagaaactgagaggtgtcctgcagaccggctgaccactccttttggagacggcaggaggcctgagcgatccgtactcagaacgtccaggagagacgcatggcccgaagtcaaagtgctggaattttccaaaacagcctgttctctcctctctcctccccagagcaccccctgccatcaggggggttgaaatccctctcccccaggagccctgctgctttgcttggtggtagggcaggagagcaaacaaacagtcatggtctaaaacccacatagcactttgctcttagttacatgtaaaattttagatttctaaaacaggtgggcaatcattttgaatactgttctgtgaccctgactgctagttctgaggacactggtggctgtgctatgtgtggccatcctccatgtcccgtccctgtagctgctctgtttagacagcggacagacgctcacgcccaggggatgtcctcacgctgtcgccgcgcggtttcccttcgcagatgtgtatactcatgataggtcagaaagtgtatccgctacaataaagttctggttctaact

SEQ ID NO: 113730 - DNA, 14202 bp, Homo sapiens
  Payload ID: 2221
  Gene Symbol: CLSTN2
  Gene Name: calsyntenin 2
  Uniprot ID: Q9H4D0
  ENST ID: ENST00000458420
  CDS Start-End: 191-3058
agtgagcgcggctgctgccggcgagctagcggcgcagcggcgggaacccgaggccgagcgccgcggcggcagcgctagaagcgcacccatcgggcacggcgaggcggcccacggtgcggcaggcaccgggaggcgagagccggcgcggacagtaggcggcggctgcagctcgttggcggctgctgcgaggatgctgcctgggcggctgtgctgggtgccgctcctgctggcgctgggcgtggggagcggcagcggcggtggcggggacagccggcagcgccgcctcctcgcggctaaagtcaataagcacaagccatggatcgagacttcatatcatggagtcataactgagaacaatgacacagtcattttggacccaccactggtagccctggataaagatgcaccggttccttttgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcaaaagttatgtggagcctcctctggcatcattgacctcttgccatcccctagcgctgccaccaactggactgcaggactgctggtggacagcagtgagatgatcttcaagtttgacggcaggcagggtgccaaagtccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgctttggggaagacgtatgcatcagtatccctgaggtagatgcctatgtgatggtcctccaggccatcgagccccggatcaccctccggggcacagaccacttctggagacctgctgcccagtttgaaagtgccaggggagtgaccctcttccctgatatcaagattgtgagcaccttcgccaaaaccgaagcccccggggacgtgaaaaccacagaccccaaatcagaagtcttagaggaaatgcttcataacttagatttctgtgacattttggtgatcggaggggacttggacccaaggcaggagtgcttggagctcaaccacagtgagctccaccaacgacacctggatgccactaattctactgcaggctactccatctacggtgtgggctccatgagccgctatgagcaggtgctacatcacatccgctaccgcaactggcgtccggcttcccttgaggcccggcgtttccggattaagtgctcagaactcaatgggcgctacactagcaatgagttcaacttggaggtcagcatccttcatgaagaccaagtctcagataaggagcatgtcaatcatctgattgtgcagcctcccttcctccagtctgtccatcatcctgagtcccggagtagcatccagcacagttcagtggtcccaagcattgccacagtggtcatcatcatctccgtgtgcatgcttgtgtttgtcgtggccatgggtgtgtaccgggtccggatcgcccaccagcacttcatccaggagactgaggctgccaaggaatctgagatggactgggacgattctgcgctgactatcacagtcaaccccatggagaaacatgaaggaccagggcatggggaagatgagactgagggagaagaggaggaagaagccgaggaagaaatgagctccagcagtggctctgacgacagcgaagaggaggaggaggaggaagggatgggcagaggcagacatgggcagaatggagccaggcaagcccagctggagtgggatgactccaccctcccctactagtgcccaggggtctgctgcctggcccacatgtcccttttgtaaaccctgacccagtgtatgcccatgtctatcatacctcacctctgatgtctgtgacatgtctgggaaggccttctccagcttcctggagcccaccctttaagccttgggcactccctgtgtttcatccatggggaagttccaagaagcccagcatggccatcagtgaggacttcagggtagactttgtcctgtagcctccacttctgccctaagttccccagcatcctgactacctgtctgcagagtttgcctttgttttttcctgcagggaagaaggcccacctttgtgtcactcacctccccaggctcagagtccccaaggccctggggttccaactcactgtgcgtctcctccacacagaccagtaggttctcctatgctgactccaggttgcttcatacaaggagggtggttgaacttcacacacgtaaggtcttagtgcttaacagtttaaaggaaagtccttgttgaggcagaactaagtttacagggaaaggtacacacattctctctctctctctctctctgtctatctagttccccagcttggagagcctttccccttgcttctttctgaggccatataagcttataagaaaagtcccaaaccaagaataggtccttggccacaagcagggtctgatcccccatcagagctatctgagcctgcctgtctgggcacctgctgcaaccatgcagctaccctgccaggggcactcagcaaacagaaccacagggcccaggaggcattccacacaggcactgccccaggacaacacaacaaggacagtcacaacaaggacaacaaggacacaacacaacacacaacaaggacagtcacaacaagcctagagccagaaagcagatggaaatgctaatgaggtcaaacgtaggcttcatggtgggtggagtgggggtggctgggctcccccaggacagaggggaccctgaggttggcaaggctctcaccactcagccttatggtcccttatctcctatcttccctcttgagaaaatacacgctttctgcatgtattagaaacgcacgagctccaccaagtctacaatgaaagtttgaaatttaactgcaaggaattagaagcatatttgcaatcattgcagcttcttctttcttctgctcataaaaggaggaacactttagatagagggcaaatatatctgaaaacctaatttctttctttttttgataaggaaatcttttccatctccatcctaacatgcacaacctgtgaagagaattgtttctatagtaactggtctgtgatcttttgtggccaagagaatagcaggcaagaattagggccttgacagaatttccacgaagctctgagaacatgtttgtttcgaatgtctgattcctctttgtcatcaatgtgtatgctctgtccccatccttcactcctcctcaagctcacaccaattggtttggcacaggcacagagctggtccctagttaagtggcatttatgttaaaaaaaaatagttcagaatctcagccttttctttgtgtcatcaaaacagcttaagaaggggactactgccaatgtcctctagtctgacctccacccagggaggacccatggcaggtcttttcaactttctgattcatgagaacaaccttgtgaagcttttcccacctcctaaagtgttttctgcatctgttccttcctttggacctcacaacaaatcctgtgaagtaactgagacatctgttgttagatacatttttgtgatgagtaaactgaggcttcgtgattcaatgtcttgttcagagtcattcaaaagtatagacaagaccagtctccccaacttccactcctggtgcaggattctacttatgttcataggtatgcacctaacagacactgctgcaaacctactatgtgctaagcatcctaccaatagctgtgagaaaaagaaaagctgaataagataagctccttccctacattatatttgcagacgggaaataaacaggcctagaaattacacaagagacaaatgaagaggaagagaagtcacaagagaagaaggatgcggtcacaaacttaaccagtgctcttatttttcccttctcagggaaaaacaccagaagaagctggggttttatattcattggatggaaacagatatttctcctgggaattctcccaaccaaatagcccttttctattaggctgtgtctgtacatccacaagaggaaagtctataggactgattagttttcacaatcccatttaaataaaaaaaagatctttagttgggcatttaggagcaactgaattctcccaaaattgtggcagcaaaaagaacacttcatatgcttaaaacccattctttttgaattagattttgattttaaatatttaagtctggtgtttgtgagaacacttttctctttgctcagtcttttcgatctggttgggtagggaaggtgttcctcatgctctctgggtggctgccttattcatagttgagagagctgttaggtaaaatctttatatgtgttggggtttttttggtagggggggtagcaggtaaaggtggcccatggctagggcagcaaagatgaataatttgaggaagcatttggttggtggactcatttgcagagaaacagtggtgacaacaaatcagagctgtttccctcaactctggctataagaggtcattctctgcatgtcagctacaaagatcaggcacttgaatgaatccgctgggttggcaggcattggtcatcttcgcaacaccctcttcctcaccatggatgagaacaagacgggagtggttatatcccagtaacagaagctttgggaggtatccaggtgagcagggtaatgtggcttgccctcccccagatattctgatcccaagaaaaaggtgtcattaatcagtctggcattttccaccctccatatgctggcatccaggaaccaaaacccctgaaggcctagacaccctatgacctctaactgagatgttggcagccaggcagatgcaggctcatgtccaggaggaactgctgactggtttggccacagcccagttcattgcttgtcttgccaagtggacaaccagattctgccttcctgagcttgaaaataggctacaactctcaggtgattcagatgacatggaggagaagttggaggagaagattgaaatgcttaaatcccagtgcagaatgagttgcttcagtggagtaaagcaaccggctagttggtagcctgccttaaaaaatactaaacatatatcatcatacatttgatcaaatgctgtaagcacagccaaggcccaaattcatctagataccaaaaatgtgatttcagtgaaatctcttttcattgccgctttcttttgttgttgtttgttttttgagccagagtcttgctgctctgtcacccaggctggagtgcagtggcacaatctcagctcactgcaacctccacctcccgggttcaagcgagtttcctgcctcagactcccgagtagctgggattacaggcatccaccaccatgcccagctaatttttgtatttttagtagagacagggcttcaccgtgttggccaggctggtctcaaactcctgatctcaggtgatctgcccaccttggcctccaaggtaatgagattataggagtgagccaccgcacccagccctcattaccactttcttgaatttactcaatcatcctatcaagcagggtttagaccaacatctttgcatttaataagggctctactttgtatacatggaccatccagtgagagagctgggggtggtgagaagcaatgtcccccattcctatatgtcaggtgtcagcaaactatctgtaaagaggcaaatagtaaatattttgggctttgtgagccatttggtacctgtcacagaatagtcagccctccatatctgaggtttccaaatccatggattcaaccaaccttgaatcaaaaatatttgggaaaaaatgtatagttgcaactgacctgaacatattctttttttcattattattccttgaacaatacagtttaacaggatttacatagcatttacactgtattaggtattataagtaacctagagatgatttgaagaacacaggaagttgtgcataggctatatgcaaatactatgcattttatataaaggaattgaacatctgtggattttggtgtccgaggggagttctggaaccaatcccctacagatactgagggatgactgtactcagctctcctattgtagcatgaaaacagacaatacgtacaacaaatgaatgtttcaatacaactttatctagtttccataaaacaatttaaaaacactaaaaaagcaggcagtttggatttatgtaattttcatatctttttttacccttttgatttacatttttaataatttaaaaatataaaaaccttcctcagcccacaggccatacgaaaattagcagccagctagatttggcccaaggccaaagtttggcaacccgtaccatacaccatggaagttagccttccacctcaggagaaagcaagctgctctcataagcctctcaccaactacccagtagtctttgcctccaaactgaacaacaggaaaaagtgccatagtttttaattaagctgttttaaaagtccatgttccgggggaaaacaaaaaagaaacaaacaaaacacttgttatttgctgaactgacaaactgacagatattccacgagagttgaaagccttggatcgaggtgattgcctggttactgagtgctaactccactgaggcaagtgttagccccccaaggctcagtgccttcccagcacagctcagcccataatgatctctgagcaggagtgttcattatctcagactgattttcatttcagccctactcttgccattgctctaaaaatgatcctaaagacttgtgactgtttgaatcaatagcaacatcatcagtagaaagcccgaccaagcacacttcgaaattagcaatcttcttggctctatggctcaatatcagcaagaagaaaaaaagacaactttttttttaatcatccccacatttaaattaaccaaatagtttttacaaaaaagtaggtaagtgggtttaattctttgaaagtatttgccagtgaaaagtagatgatttttaggtaagataacgtttaggcctctgggggatccccaaagccttctgcaatgtactctggcaggctatgaatggtacaggattctgcatctatatgagacatttattgaggctgacaagcaaaagcccttggcacaatttaattttcacataaccactttccattgtccagctgcaggcaaaagaaatgagcaatgaaagttttgaagtctaccccagtaccctcatttcctgtctttatttcctttactttatagatgtattctatacctgctatgtagataatgctctagttttccctttagtgccaactggaaaaggagagttggctttacaggggctgtggattaagagccaggcttcattccatcccagggagacaaaaagagacagaagaagttacctccagcagcaccccagaaagctgacagatattccctgtatgcaggtagtaaacagatgggagtctgtgtttgcagctatgttcagtgtaattcagcagaccttcactgggcacttgtgatgggtcaggccctgtgccagcaacaggggaagggaggatgaacaaggcatgtttccctgaccatgaggagctcttggcctgtgagctgttgggatgtccctttgtggtgttggaagctgtgcacgagcagtcaggactttggggacagaagtttagtgttagggaggcagggtaacttgctttgacagctacccaccctaagtcagatgacaggtgtaattctaggggccctgatatgcatcactgaggcagactgaggagctctccagggaagtaggcaatatttccctgaatattcctcaattccaatcaaggctgactcagttcacttatggatgaaagccagttaccctgcccactgggcagaaataacatggttgacagctgacattcagagaaaataagacagaagcagtccttaaatataaacagcagccaggtggacctggaaatttaggaagggtgatgcaggtagaggggccagcaggagccaagtctcaaaaggcacaagccagactgatgcaagggagccctcctgaggcccaacatcagagctgaagatctaaggagggcccacctccacgagacctgctgagggcttacatttggtgctgaggagcagtggttccctgggccagctgcatcacctgggaacatgtgagaagtgcatattcttgggccccaccccagacctactgaatgagaagctctggaggcaggcagtctgtgatttaatgagctttctgacacacactaaagtttgagaaccactgatgcagaggatgaggagatgacttgagctggcatcgggaagaactgactattaactaacaaggtaaaatcaatgactagtgcagtgagggtgccaaagcaaaccacccccagcccccatcctgggcctttttggctccagtttatactcactgaagcagtggtttcaaggaaccttggtcctagtccgcatccttcacctgcccttgggcatgagacaattcctgcctgcctgccccttctatcctagagagagagactgcccaggagaggctgccatgaggtcactcatccccaggaaggccacctgccaggtttctgtaagctgagcagcctcttcgagggccatattttgtggagaaacactgaaactgcagcagtgaccctggtcactaggagagctgctttctacacagcctgtatgctggtggagacacccagggcctggcagagtgtggagggggtcatttaaggacgttgccaggttgccgcagcactgctctgtttgtttgtaatgagactggggcatgcagcatcacaattcaaacactgaattgcttggggaatggatggccttccttggaagggcagtaactcattctggatgttactaaaagtagaaaacaaaaatccaaaaacaaacctacagcctcatttacaattagaatctgtctgggccttctgatttctaaagtctgtgaggctgccaggattcaccaattctcctttcccctgaggcccagcaactattgatttatagcttaaactctgtgaaggtccacagacctttgaaaggaacttgctggtactttgtcagtcgtgtacacctaactgactcctcctacgaggtacagtctcctcatacaaggggttttgagatggagagtcagagggccagggccctgggctttggggtggaaggacagaagagtagcagtctaggaaagggactagacatgtagcctaggaaaactagcaccatctgttgagttctgaagaacccagattctctcctgctcacagcctcagcagtcttttcagagtcctcctgaatggcccaaagacacccctgtttctggggaacagaagggagctggtacctctggaccattgaggcaacacctccccagaggcaggaccccgcccccatgagaacatgcagttgaatgatgtggtgcctggccaggaccttggaaaacgtggccatgtgagactagtatagatctccaactattgctgcctctgctgatatggccacctccttaaggtaagaagactaccgacttagctattgtggcaccacgggagcctagcactgcacctggcccatgacatgtgtgccacaaatgttgaattgaattgaatcccagagatcacttgacctcagtgaagggactgggtttgaagaattaagaccccccagtggagaaagcctcctccaacttccttctcggtttgtgagtcaaggtcctttgtaaaatcagatcgacgagggtggaagtgcagtgaacagaggacaacatttgtgatgcacgtgggagaaaacaggagtggggttgtttggggactaccccttcctagctatagtcagtaaatggagcccctaagcaaggagcaggggtagatgtgcctgggtgaggcctgcttgctccaccgtcgaggtcatgggcagcatcccaactgaggagagaaaaccctaatttgttaatgacccagccttgtgctgctctccagttcctttcatcagatttactgcagagcagattcatcaacatgaagttcaattcccagtagactaatgaaaagagggcaacagacttgagaagagccaaaatgcagacagtgtgtattaatcacagacaacagaaacgtgttagctttaatgtctgtttgcttttatcttgaaatgaaaatgcatctctgttacctggaccctttttactgcacatttcagaacagaaatgggacacccacacacgtattgagggtccttttccccggcaggaggagctaccagagaaatgagcccacattttgtgtgcagagagaatcaacccacaggtctcagctgcagactccagcacctctgcagagaaggcaggcaaagggatgaggaggtagcatctcctcttcagaaggattcataagggcctctgtgaggagggccttgcttgtgcctgtgggtcatggatgttaatataaaggctcatccacccttggtggcaaaagtgcatccatcctggccaatatagaacactcacatctggagcccacgcccacccacctccagctcctctacatggctgcaagagcatggctgatgtgtgggattcagaagaggtctgctcatgttcactagccaaactttaggtggtgtgatacagcaaaaagctttttttgtttttctgtttttgttttgtttttggcgtggaggagaaatttagacttgaaagtcagggctgatcactcaaaaagtaagataggagatattgagggaaaatgtgactcatagttggagaggaaacaggagagtgggtacaagtgacagcaccaggaacaaccccctcccccagatgccaaagcattgctctgtatctaaagatgcatccaagtttgcaaaaaattatgggtaaatctggccatgtgaccaaagaggcagtcaaatcaattgcttccaaagtcagagctgtttgaaggtgatcagctcttaattgaactagtcatgatgaatcaatccaactgactgcatccagtctgacctcggtggtttccataaagggttgttgatgtcctgagctggacagggtgggcaggaggttgaagaaaaccagttggtgagtatagaaaagaaattgcatgtagaagttgtttgttctcaaagaaatctgtaggtgttagagctgggtttgttatgttattgtcagggacattataatattggtaaggaggagagaatgatttggtaggggtattcgagaaatttgagtacaaaatataaattatcagagatgagtaggctatggacagctgattatatatatgtgtgtgtgtgtatatgtgtgcatatatgtgtacatatacacataccccaaagccatatacatatctataatacagaagtaagaataaagtcataagtaccagcatattttaaatccttagaagcactggttgggatgttacatgttttttcactgttgttgtttaccgttagctctcaaagcagtgggaatagtgcttggcacatagtaggagtttggtaaacatttggaaattgaagacccagcttatcactccttcatagagactcagtagtatgagtataccccaaattgaatgagccacagagaaatgcatccagccacactccctcttagctgaggagaagcctctgtgaatccacagattccatgcaatattcagccagccgcagacacaaggtctggctcccttgtcgtgagagtgaaggcatgctgcacacagtgggtttgcatgcacctagactgcatctgctgaacacccaacagctgtttctacaagctaaagttgtagcttctctctaccactgtctaaagctgtagcttgtctctactattgtctctacaccgttgcccaaacacttggtataatgctattgaatttttcacctccaggcatgattttgtaaccaatgtaaaggttctgggttcagccagtctaaaaagtctaataatttcttctctcagtccttcccttctcccttgtctggagctgccaccgccatttaaaagtgttggacgctgtttattcccagcttctcaacctcagtgtgtgtgggaaaggcctgaaagagagaggtatgttttctctcctccagagtctctgtggtgttgacacagcagagagaggagggggagcagcctcgtcttgcagaatcaccttcaatcactgctactgtctgggccattactgccagtctggccggtgtctcccacagtggatggctttgcctccagcggtggaccagtgtgtacctgacatgtatcagacttctgagctcttcaagctgcctcaaagaatgaatctttttagtctagaaaatgtgtttatttgataaatatactattgtgtatgagtgtgaaacaatgcagactttggagtatctcattagaaggactgtatgaatttatagaaaattgaatctaatttcagaagagcgcactgtcttctcagtcaacaaggttgcccagccacagagggtcagagaaaatgtcctttcccctccccactccttttcatagaatcctctctcaggcctaactgagctgtcatatccaattcagactgacacagagtgaggggcgctgagagtctctatgtatataaagatataggaagaaaataaggatcatcacaggaatctgttgggcttctccccatgactgtgatcttacccatgtttgaatcacaaactttaaatttataataattatgattcttgcagttttcaagtaatttgttaaatgcctattcaacacagacagatttttattttcagctgtggcttgtaaatgcctacaaactgattcatgttggtggtcgttatgacactttctgtgaattggtgaataaatatgattttagaatttcacagtaaa

SEQ ID NO: 113731 - DNA, 4500 bp, Homo sapiens
  Payload ID: 2221
  Gene Symbol: CLSTN2
  Gene Name: calsyntenin 2
  ENST ID: ENST00000620185
  CDS Start-End: 1-2676
ctggcatctcaggattcccactcactgtttccttctgcaggggaaatctgtgcgttcaagatccatggccaggagctgccctttgaggctgtggtgctcaacaagacatcaggagagggccggctccgtgccaagagccccattgactgtgagttgcagaaggagtacacattcatcatccaggcctatgactgtggtgctgggccccacgagacagcctggaaaaagtcacacaaggccgtggtccatatacaggtgaaggatgtcaacgagtttgctcccaccttcaaagagccagcctacaaggctgttgtgacggagggcaagatctatgacagcattctgcaggtggaggccattgacgaggactgctccccacagtacagccagatctgcaactatgaaatcgtcaccacagatgtgccttttgccatcgacagaaatggcaacatcaggaacactgagaagctgagctatgacaaacaacaccagtatgagatcctggtgaccgcctacgactgtggacagaagcccgctgctcaggacaccctggtgcaggtggatgtgaagccagtttgcaagcctggctggcaagactggaccaagaggattgagtaccagcctggctccgggagcatgcccctgttccccagcatccacctggagacgtgcgatggagccgtgtcttccctccagatcgtcacagagctgcagactaattacattgggaagggttgtgaccgggagacctactctgagaaatcccttcaaaagttatgtggagcctcctctggcatcattgacctcttgccatcccctagcgctgccaccaactggactgcaggactgctggtggacagcagtgagatgatcttcaagtttgacggcaggcagggtgccaaagtccccgatgggattgtgcccaagaacctgaccgatcagttcaccatcaccatgtggatgaaacacggccccagccctggtgtgagagccgagaaggaaaccatcctctgcaactcagacaaaaccgaaatgaaccggcatcactatgccctgtatgtgcacaactgccgcctcgtctttctcttgcggaaggacttcgaccaggctgacacctttcgccccgcggagttccactggaagctggatcagatttgtgacaaagagtggcactactatgtcatcaatgtggagtttcctgtggtaaccttatacatggatggagcaacatatgaaccatacctggtgaccaacgactggcccattcatccatctcacatagccatgcaactcacagtcggcgcttgttggcaaggaggagaagtcaccaaaccacagtttgctcagttctttcatggaagcctggccagtctcaccatccgccctggcaaaatggaaagccagaaggtgatctcctgcctgcaggcctgcaaggaagggctggacattaattccttggaaagccttggccaaggaataaagtatcacttcaacccctcgcagtccatcctggtgatggaaggtgacgacattgggaacattaaccgtgctctccagaaagtctcctacatcaactccaggcagttcccaacggcgggtgtgcggcgcctcaaagtatcctccaaagtccagtgctttggggaagacgtatgcatcagtatccctgaggtagatgcctatgtgatggtcctccaggccatcgagccccggatcaccctccggggcacagaccacttctggagacctgctgcccagtttgaaagtgccaggggagtgaccctcttccctgatatcaagattgtgagcaccttcgccaaaaccgaagcccccggggacgtgaaaaccacagaccccaaatcagaagtcttagaggaaatgcttcataacttagatttctgtgacattttggtgatcggaggggacttggacccaaggcaggagtgcttggagctcaaccacagtgagctccaccaacgacacctggatgccactaattctactgcaggctactccatctacggtgtgggctccatgagccgctatgagcaggtgctacatcacatccgctaccgcaactggcgtccggcttcccttgaggcccggcgtttccggattaagtgctcagaactcaatgggcgctacactagcaatgagttcaacttggaggtcagcatccttcatgaagaccaagtctcagataaggagcatgtcaatcatctgattgtgcagcctcccttcctccagtctgtccatcatcctgagtcccggagtagcatccagcacagttcagtggtcccaagcattgccacagtggtcatcatcatctccgtgtgcatgcttgtgtttgtcgtggccatgggtgtgtaccgggtccggatcgcccaccagcacttcatccaggagactgaggctgccaaggaatctgagatggactgggacgattctgcgctgactatcacagtcaaccccatggagaaacatgaaggaccagggcatggggaagatgagactgagggagaagaggaggaagaagccgaggaagaaatgagctccagcagtggctctgacgacagcgaagaggaggaggaggaggaagggatgggcagaggcagacatgggcagaatggagccaggcaagcccagctggagtgggatgactccaccctcccctactagtgcccaggggtctgctgcctggcccacatgtcccttttgtaaaccctgacccagtgtatgcccatgtctatcatacctcacctctgatgtctgtgacatgtctgggaaggccttctccagcttcctggagcccaccctttaagccttgggcactccctgtgtttcatccatggggaagttccaagaagcccagcatggccatcagtgaggacttcagggtagactttgtcctgtagcctccacttctgccctaagttccccagcatcctgactacctgtctgcagagtttgcctttgttttttcctgcagggaagaaggcccacctttgtgtcactcacctccccaggctcagagtccccaaggccctggggttccaactcactgtgcgtctcctccacacagaccagtaggttctcctatgctgactccaggttgcttcatacaaggagggtggttgaacttcacacacgtaaggtcttagtgcttaacagtttaaaggaaagtccttgttgaggcagaactaagtttacagggaaaggtacacacattctctctctctctctctctctgtctatctagttccccagcttggagagcctttccccttgcttctttctgaggccatataagcttataagaaaagtcccaaaccaagaataggtccttggccacaagcagggtctgatcccccatcagagctatctgagcctgcctgtctgggcacctgctgcaaccatgcagctaccctgccaggggcactcagcaaacagaaccacagggcccaggaggcattccacacaggcactgccccaggacaacacaacaaggacagtcacaacaaggacaacaaggacacaacacaacacacaacaaggacagtcacaacaagcctagagccagaaagcagatggaaatgctaatgaggtcaaacgtaggcttcatggtgggtggagtgggggtggctgggctcccccaggacagaggggaccctgaggttggcaaggctctcaccactcagccttatggtcccttatctcctatcttccctcttgagaaaatacacgctttctgcatgtattagaaacgcacgagctccaccaagtctacaatgaaagtttgaaatttaactgcaaggaattagaagcatatttgcaatcattgcagcttcttctttcttctgctcataaaaggaggaacactttagatagagggcaaatatatctgaaaacctaatttctttctttttttgataaggaaatcttttccatctccatcctaacatgcacaacctgtgaagagaattgtttctatagtaactggtctgtgatcttttgtggccaagagaatagcaggcaagaattagggccttgacagaatttccacgaagctctgagaacatgtttgtttcgaatgtctgattcctctttgtcatcaatgtgtatgctctgtccccatccttcactcctcctcaagctcacaccaattggtttggcacaggcacagagctggtccctagttaagtggcatttatgttaaaaaaaaatagttcagaatctcagccttttctttgtgtcatcaaaacagcttaagaaggggactactgccaatgtcctctagtctgacctccacccagggaggacccatggcaggtcttttcaactttctgattcatgagaacaaccttgtgaagcttttcccacctcctaaagtgttttctgcatctgttccttcctttggacctcacaacaaatcctgtgaagtaactgagacatctgttgttagatacatttttgtgatgagtaaactgaggcttcgtgattcaa

SEQ ID NO: 113732 - DNA, 4185 bp, Homo sapiens
  Payload ID: 2222
  Gene Symbol: CLSTN3
  Gene Name: calsyntenin 3
  Uniprot ID: Q9BQT9
  ENST ID: ENST00000266546
  CDS Start-End: 451-3321
agttcctcggctcccccaaaattgcagccaggggaaggagccttgaaactctccagccccgacgccccagtctcattggctccctcccccgctgcagcacctggtccccccccctcccagtcacctgattggccggcggccccatcaatcgttgcccggctgtgctgacgtcatcctgcagtagcggggttggggtgggagtgagagagtgaggacgctgggctgggggaaacgggaagccgctgcaagtccaccgcctcagctacccagattgggatctgcccaggcccgctttatggactagtgtgggcggcaggctcctttccgtccctgccctgctgtaccccgctccttggagaccccctgtatccctcccgcaaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcagaaaaaaaaaaaaa

SEQ ID NO: 113733 - DNA, 4296 bp, Homo sapiens
  Payload ID: 2222
  Gene Symbol: CLSTN3
  Gene Name: calsyntenin 3
  Uniprot ID: Q9BQT9
  ENST ID: ENST00000537408
  CDS Start-End: 539-3445
gcattgattcctctgctccattcctgcccctctctgccccctccctctgtcctatatatcttcacttctctcctttctccccatcctgtgttctgggagagtggcctcaagttggggcttggctgggagaagtgcagagtgaagggatcaggactgaaatgagttgggaggaggataagcaatcaggatctcaggaaacttctagatctttttctagtttcaattctgcccttaatctatcccttccctttcccagggccttctcacagcccaccactgctccctgaagttccctgtctccattctctagcacgtgaaatcgctaaagaacattctccacttcctgaccatggttcccatggagatagtgatcccctcctcttcacccccagggcaggttgtttccatgggaactgtctaccctgctataggagaaggctatgacctcccgcagaccctctgactcctttagtagctgatttcttgtcctcaaccacccgcctcctgtaaggtgctcctatagggggtggaaaaggtgatggtgctggggtgtgagttgtctgggtcaacaagggttgttgtgggagtagaggccctgctcacaggtgcttcctctcctctccctggggtggggccagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcattgacaatgacgggaacattgagaacacagagaagctgcagtacagtggtgagaggctctataagtttacagtgacagcttatgactgtgggaagaagcgggcagcagatgatgctgaggtggagattcaggtgaagcccacctgtaaacccagctggcaaggctggaacaaaaggatcgaatatgcaccaggtgctgggagcttggctttgttccctggtatccgcctggagacctgtgatgaaccactctggaacattcaggccaccatagagctgcagaccagccatgtggccaagggctgtgaccgtgacaactactcagagcgggcgctgcggaaactctgtggtgctgccactggggaggtggatctgttgcccatgcctggccccaatgccaactggacagcaggactctcggtgcactacagccaggacagcagcctgatctactggttcaatggcacccaggctgtgcaggtgcccctgggtggccccagtgggctgggctctgggccccaggacagcctcagtgaccacttcaccctgtccttctggatgaagcatggcgtaactcccaacaagggcaagaaggaagaggaaaccatcgtatgtaacactgtccagaatgaggacggcttctctcactactcgctgactgtccacggctgtaggattgccttcctctactggcccctgcttgagagtgcccgcccagtcaagttcctctggaagctggagcaggtctgtgatgatgagtggcaccactacgctctgaacctcgagttccccacagtcacactctataccgacggcatctccttcgaccctgccctcatccatgacaatggcctcatccacccaccccgaagggagcctgctctcatgattggggcctgctggactgaggagaagaacaaagagaaggaaaagggagacaacagtacagacaccacccaaggagaccctttgtcgatccaccactacttccatggctacctggctggtttcagcgtgcgctcaggtcgcctggagagccgcgaggtcatcgagtgcctctatgcatgtcgggaggggctggactatagggatttcgagagcctgggcaaaggcatgaaggtccacgtgaacccctcacagtccctgctcaccctggagggggatgatgtggagaccttcaaccatgccctgcagcatgtggcttacatgaacactctgcgctttgccacgcccggcgtcaggcccctgcgcctcaccactgctgtcaagtgcttcagcgaagagtcctgcgtctccatccctgaagtggagggctacgtggtcgtccttcagcctgacgccccccagatcctgctgagtggcactgctcattttgcccgcccagctgtggactttgagggaaccaacggcgtccctttgttccctgatcttcaaatcacctgctccatttctcaccaggtggaggccaaaaaggatgagagttggcagggcacagtgacagacacacgcatgtcggatgagattgtgcacaacctggatggctgtgaaatttctctggtgggggatgacctggatcccgagcgggaaagcctgctcctggacacaacctctctgcagcagcgggggctggagctcaccaacacatctgcctacctcactattgctggggtggagagcatcactgtgtatgaagagatcctgaggcaggctcgttatcggctgcgacacggagctgccctctacaccaggaagttccggctttcctgctcggaaatgaatggccgttactccagcaatgaattcatcgtggaggtcaatgtcctgcacagcatgaaccgggttgcccaccccagccacgtgctcagctcccagcagttcctgcaccgtggtcaccagcccccgcctgagatggctggacacagcctagccagctcccacagaaactccatgatacccagcgccgcaaccctcatcattgtggtgtgcgtgggcttcctggtgctcatggtcgtcctgggcctggtgcgcatccattcccttcaccgccgcgtctcaggggccggcgggcctccaggggcctccagtgaccccaaggacccagacctcttctgggatgactcagctctcaccatcattgtgaaccccatggagtcctaccagaatcggcagtcctgtgtgacgggggctgttgggggccagcaggaggatgaggacagcagtgactcggaggtggccgattcccccagcagcgacgagagacgcatcatcgagacccccccacaccgctactaaggcctacacctctccccacgcagagggggaattctgccctggtgaaacagacactccagacatgggagaaggactttctgggaacacagagaccaagagggagagaggcttcagaaccagtcctcctttcatttcaaaaccccagcgggccctctggagtccgccctgcccctcccccggccccccatccctcacttctgggctgtcatgctcctggtgtgccccttgcactggggctggctgggttggaaagtgggctggacttcagctgcctttctacccccaatggcagctgcccccttagcactcactgtgttggggagagggtgacgattgcaatggctggggctggggctgggggtgggattgaaggaaaccctctcctctccccttcccttctctctcctgtccatgggaagcttttccccctctgcagggctccctcagctggaccatcgtccctgcttctcttatgatcgccccacctcatttccatttcagtctggggaccccatttctccctcctttccaacttccttcctttcttgtcctgtttcccttcctgcccttgcagtcctgaggtcctgcagccccggcccctcctccgtgacctggtgtggccaggctgcggggacgggaggggacgtgggggccccgggtgtacatatataatgtatattttttcaatgttgtcgtgagtgcagcccatgttcctgcgtgcagctcacggccttgtgtgtatgtgtgtgtgtgtgtgtgtgtgaggcatcgtcatgtcctggggcaggggcggggggttgggtgtggtgagggaggggacatatcctagggttttcaaataaaacaatcag

SEQ ID NO: 113734 - DNA, 533 bp, Homo sapiens
  Payload ID: 2222
  Gene Symbol: CLSTN3
  Gene Name: calsyntenin 3
  ENST ID: ENST00000545663
  CDS Start-End: 107-533
gcagcgccgtgcggggtgggggtgggaaggaggtgtcgaggctccctggcacctgacagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccaga

SEQ ID NO: 113735 - DNA, 570 bp, Homo sapiens
  Payload ID: 2222
  Gene Symbol: CLSTN3
  Gene Name: calsyntenin 3
  ENST ID: ENST00000539982
  CDS Start-End: 41-570
accatcttgtggctttctcctcagcattcaggaaggggttatggtggtcatcaccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacacccctttcctcat

SEQ ID NO: 113736 - DNA, 533 bp, Homo sapiens
  Payload ID: 2222
  Gene Symbol: CLSTN3
  Gene Name: calsyntenin 3
  ENST ID: ENST00000535452
  CDS Start-End: 145-533
actggcgcatgctaagggtgtgtggcagatccatctgcttcgcctccatcccatcctggggagaaagtatttgctgcagttcagcaattcggagcacccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtgga

SEQ ID NO: 113737 - DNA, 547 bp, Homo sapiens
  Payload ID: 2222
  Gene Symbol: CLSTN3
  Gene Name: calsyntenin 3
  ENST ID: ENST00000534830
  CDS Start-End: 84-547
aggacgggagggagggcttgcgggcagagggctcagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgggtcaacgatgtgaacgagtttgccccagtgtttgtggaacggctgtatcgtgcggctgtgacagaggggaagctgtacgatcgcatcctgcgggtggaagccattgacggtgactgctccccccagtacagccagatctgctactatgagattctcacacccaacaccccttt

SEQ ID NO: 113738 - DNA, 570 bp, Homo sapiens
  Payload ID: 2222
  Gene Symbol: CLSTN3
  Gene Name: calsyntenin 3
  ENST ID: ENST00000541953
  CDS Start-End: 169-570
aattctctctcgaacctgccatcgtcccgggcttcagaatccactgggcttggttcatcatggtttaaggtgaaattcggggcgaaggaggcaggacaggtggaatccgcaggctggaggctcccaggggaggcaaacgcctggccctgccctgccccacgccgcaccatgaccctcctgctgctgccccttctgctggcctctctgctcgcgtcctgctcctgtaacaaagccaacaagcacaagccatggattgaggcagagtaccagggcatcgtcatggagaatgacaacacggtcctactgaatccaccactctttgccttggacaaggatgccccgctgcgctatgcaggtgagatctgcggcttccggctccatgggtctggggtgccctttgaggctgtgatccttgacaaggcgacaggagaggggctgatccgggccaaggagcctgtggactgcgaggcccagaaggaacacaccttcaccatccaggcctatgactgtggcgagggccccgacggggccaacaccaagaagtcccacaaggccactgtgcatgtgcgg

SEQ ID NO: 113739 - DNA, 3357 bp, Homo sapiens
  Payload ID: 2223
  Gene Symbol: CALU
  Gene Name: calumenin
  Uniprot ID: O43852
  ENST ID: ENST00000249364
  CDS Start-End: 103-1050
gcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattca

SEQ ID NO: 113740 - DNA, 2438 bp, Homo sapiens
  Payload ID: 2223
  Gene Symbol: CALU
  Gene Name: calumenin
  Uniprot ID: O43852
  ENST ID: ENST00000449187
  CDS Start-End: 82-1029
gcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgcc

SEQ ID NO: 113741 - DNA, 589 bp, Homo sapiens
  Payload ID: 2223
  Gene Symbol: CALU
  Gene Name: calumenin
  ENST ID: ENST00000493278
  CDS Start-End: 1-442
cattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagccgtataactggagagacctgctgctcgttatataattatctgataccaaacacaagcgattctgaatgtacacacacgtttatctatagagcataaggtaaaacaattttgtttaa

SEQ ID NO: 113742 - DNA, 2572 bp, Homo sapiens
  Payload ID: 2223
  Gene Symbol: CALU
  Gene Name: calumenin
  Uniprot ID: O43852
  ENST ID: ENST00000479257
  CDS Start-End: 832-1803
atcctgtgctgtgggggctacgaggaaaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgtactctgcagcttctttgcaggttttttgtcacatttttcagtcaagtgttccagctttgtgcttgttcattagagtcacctgtgactacagagattctgaaagtttgaatcagggcctgggaatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactgatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctgg

SEQ ID NO: 113743 - DNA, 4225 bp, Homo sapiens
  Payload ID: 2223
  Gene Symbol: CALU
  Gene Name: calumenin
  Uniprot ID: O43852
  ENST ID: ENST00000542996
  CDS Start-End: 944-1915
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaaggacctcccaccctcccccactgagctgccttcccagtgatgaaagaaaaaatgtaaaagcctgaaaacccttcttcttgatttttaatttttttttttccctctaagaccttaaccactctggatagtatcacggggtatcagtagagtgtgctaaacagatgtgtactctgcagcttctttgcaggttttttgtcacatttttcagtcaagtgttccagctttgtgcttgttcattagagtcacctgtgactacagagattctgaaagtttgaatcagggcctgggaatctgtactttgaacagtactacaggtggtatttatgcctaggcaagtatgggaaacaactgtgcagaaggataaagacgttcttatctatgactagaccatctgaatgatttggcctttgaaggtgactcaaggttgagcctggatgttggagacttggtgctatagaccaaggaagctgccaagtatttcgctggttcctaatctcatgaacatcagaatcacctgaaaaacatttaaagctacgaatgtctgaattcagcttcagagactctaaatcaataggagaaacttaaagcttcctagatgattctaataaccagccatgtttgaagaccagaccaccaatgcgtacaagaagtaaaggatttggagtcaacatttaaaccttggttctttcacttttaattcttatgaacttgggcaaaaggattaaaattctactttggtatcttttgaaagaaaacagaaagtggacattttaactataagtttcttatcagcctacaatcagatgaaggaaactgatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaatgattgtagataaaatagacgcggataaagatgggtttgtgacggagggggagctgaaatcctggattaagcacgcccagaagaaatacatatatgacaatgttgaaaaccaatggcaggagtttgatatgaatcaagacggcttaatctcctgggatgagtacagaaacgtgacttatggcacttacctggatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggtgacatgtacagccatgatgggaatactgatgagccagaatgggtaaagacagagcgagagcagtttgttgagtttcgggataagaaccgtgatgggaagatggacaaggaagagaccaaagactggatccttccctcagactatgatcatgcagaggcagaagccaggcacctggtctatgaatcagaccaaaacaaggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatta

SEQ ID NO: 113744 - DNA, 3210 bp, Homo sapiens
  Payload ID: 2223
  Gene Symbol: CALU
  Gene Name: calumenin
  Uniprot ID: O43852
  ENST ID: ENST00000535011
  CDS Start-End: 153-827
gattggtcgggaggccgccggcgaggcggatgagggcggggtgcggacccgcttccggttgggcggtgcttgcgcgcgtgagctgagccggtgggtgagcggcggccacggcatcctgtgctgtgggggctacgaggaaagatctaattatcatggacctgcgacagtttcttatgtgcctgtccctgtgcacagcctttgccttgagcaaacccacagaaaagaaggaccgtgtacatcatgagcctcagctcagtgacaaggttcacaatgatgctcagagttttgattatgaccatgatgccttcttgggtgctgaagaagcaaagacctttgatcagctgacaccagaagagagcaaggaaaggcttggaaagattgtaagtaaaatagatggcgacaaggacgggtttgtcactgtggatgagctcaaagactggattaaatttgcacaaaagcgctggatttacgaggatgtagagcgacagtggaaggggcatgacctcaatgaggacggcctcgtttcctgggaggagtataaaaatgccacctacggctacgttttagatgatccagatcctgatgatggatttaactataaacagatgatggttagagatgagcggaggtttaaaatggcagacaaggatggagacctcattgccaccaaggaggagttcacagctttcctgcaccctgaggagtatgactacatgaaagatatagtagtacaggaaacaatggaagatatagataagaatgctgatggtttcattgatctagaagagtatattggatggcaagcttaccaaggaggagatcgttgacaagtatgacttatttgttggcagccaggccacagattttggggaggccttagtacggcatgatgagttctgagctacggaggaaccctcatttcctcaaaagtaatttatttttacagcttctggtttcacatgaaattgtttgcgctactgagactgttactacaaactttttaagacatgaaaaggcgtaatgaaaaccatcccgtccccattcctcctcctctctgagggactggagggaagccgtgcttctgaggaacaactctaattagtacacttgtgtttgtagatttacactttgtattatgtattaacatggcgtgtttatttttgtatttttctctggttgggagtatgatatgaaggatcaagatcctcaactcacacatgtagacaaacattagctctttactctttctcaaccccttttatgattttaataattctcacttaactaattttgtaagcctgagatcaataagaaatgttcaggagagaggaaagaaaaaaaatatatgctccacaatttatatttagagagagaacacttagtcttgcctgtcaaaaagtccaacatttcataggtagtaggggccacatattacattcagttgctataggtccagcaactgaacctgccattacctgggcaaggaaagatccctttgctctaggaaagcttggcccaaattgattttcttctttttccccctgtaggactgactgttggctaattttgtcaagcacagctgtggtgggaagagttagggccagtgtcttgaaaatcaatcaagtagtgaatgtgatctctttgcagagctatagatagaaacagctggaaaactaaaggaaaaatacaagtgttttcggggcatacattttttttctgggtgtgcatctgttgaaatgctcaagacttaattatttgccttttgaaatcactgtaaatgcccccatccggttcctcttcttcccaggtgtgccaaggaattaatcttggtttcactacaattaaaattcactcctttccaatcatgtcattgaaagtgcctttaacgaaagaaatggtcactgaatgggaattctcttaagaaaccctgagattaaaaaaagactatttggataacttataggaaagcctagaacctcccagtagagtggggatttttttcttcttccctttctcttttggacaatagttaaattagcagtattagttatgagtttggttgcagtgttcttatcttgtgggctgatttccaaaaaccacatgctgctgaatttaccagggatcctcatacctcacaatgcaaaccacttactaccaggcctttttctgtgtccactggagagcttgagctcacactcaaagatcagaggacctacagagagggctctttggtttgaggaccatggcttacctttcctgcctttgacccatcacaccccatttcctcctctttccctctccccgctgccaaaaaaaaaaaaaaaggaaacgtttatcatgaatcaacagggtttcagtccttatcaaagagagatgtggaaagagctaaagaaaccaccctttgttcccaactccactttacccatattttatgcaacacaaacactgtccttttgggtccctttcttacagatggacctcttgagaagaattatcgtattccacgtttttagccctcaggttaccaagataaatatatgtatatataacctttattattgctatatctttgtggataatacattcaggtggtgctgggtgatttattataatctgaacctaggtatatcctttggtcttccacagtcatgttgaggtgggctccctggtatggtaaaaagccaggtataatgtaacttcaccccagcctttgtactaagctcttgatagtggatatactcttttaagtttagccccaatatagggtaatggaaatttcctgccctctgggttccccatttttactattaagaagaccagtgataatttaataatgccaccaactctggcttagttaagtgagagtgtgaactgtgtggcaagagagcctcacacctcactaggtgcagagagcccaggccttatgttaaaatcatgcacttgaaaagcaaaccttaatctgcaaagacagcagcaagcattatacggtcatcttgaatgatccctttgaaattttttttttgtttgtttgtttaaatcaagcctgaggctggtgaacagtagctacacacccatattgtgtgttctgtgaatgctagctctcttgaatttggatattggttattttttatagagtgtaaaccaagttttatattctgcaatgcgaacaggtacctatctgtttctaaataaaactgtttacattcatta

SEQ ID NO: 113745 - DNA, 2913 bp, Homo sapiens
  Payload ID: 2224
  Gene Symbol: CAMKV
  Gene Name: CaM kinase-like vesicle-associated
  Uniprot ID: Q8NCB2
  ENST ID: ENST00000296471
  CDS Start-End: 163-1584
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 113746 - DNA, 2818 bp, Homo sapiens
  Payload ID: 2224
  Gene Symbol: CAMKV
  Gene Name: CaM kinase-like vesicle-associated
  ENST ID: ENST00000463537
  CDS Start-End: 189-1493
aatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 113747 - DNA, 2905 bp, Homo sapiens
  Payload ID: 2224
  Gene Symbol: CAMKV
  Gene Name: CaM kinase-like vesicle-associated
  Uniprot ID: Q8NCB2
  ENST ID: ENST00000488336
  CDS Start-End: 164-1576
gatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 113748 - DNA, 3314 bp, Homo sapiens
  Payload ID: 2224
  Gene Symbol: CAMKV
  Gene Name: CaM kinase-like vesicle-associated
  Uniprot ID: Q8NCB2
  ENST ID: ENST00000477224
  CDS Start-End: 480-1985
actaatgactggcaagcgatcctatgcagctccaggactcaggctttcccccaactctccactcaccaccccttacattgggcataggaggcctcctccggccccaggctgagggcctaagggagccattgagaaccttggccagggctaagcaggccagtgctcaccagcaccgctgccatcccgcgcgctcctgctctccagtgggattctgcccttaaggctccgccagggtcggggcggggccggttgggaggccccgcccccagcccgcccccggcccggggtgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggcttctcactgtacatagagtcactggcatgatgccctcgctcccccatgcccccacatcccagtggggcataactaggggtcacgggagagcagtctcgtctcctgtgtgtatgtgtgtgagtggtgggcaggccagtggcagggccggccccagcccctgcatggattccttgtggcttttctgtcttttgctagcttcaccagtttctgttccttgtgggatgctgctctagggatactcagggggctcctgctctccttccccttcccttcttgcctcaccattcccctaggcaggccctgcaggtcccacactctcccaggccctaaacttgggcggccttgccctgagagctggtcctccagcgaggccctgtcagcggtcttaggctcctgcacatgaaggtgtgtgcctgtggtgtgtgggctgctctaggagcagatacaggctggtatagaggatgcagaaaggtagggcagtatgtttaagtccagacttggcacatggctagggatactgctcactagctgtggaggtcctcaggagtggagagaatgagtaggagggcagaagcttccatttttgtccttcctaagaccctgttatttgtgttatttcctgcctttccgagtcctgcagtgggctgccctgtaccctgaacctcatgagcctctaagggaaaggaggaacaattaggacgtggcaatgagacctggcagggcagagtacaagcccagcacccagtgtcccagccttactgggtccttaccctgggccaaacagggagggctgatacctccttgctcttcctagatgcccacctcctacaatctcagcccacaagtcctctccaccctagggggcttgctgcatggcaataactcataatctgatttggaggtttgccctttacaggggcagattttctgctcagttcaacaatgaaatgaagaggaactccctctttctacagctcacttctatcagaggcccaggtgcctcagagccacattgagttgctttttctgggatgaggaagtagggttaaactccccagtttcctgagggaggctcctgacaggtgccctttgtcagaccctaccacagcctggataggcagccacattggtcctcgcccttgctcggcactccgtggtggtcctgcccttctccctgcatgcctgtgggtctgctctggtgtgtgaaggtcggtgggttaactgtgtgcctactgaacctggcaaataaacatcaccctgcaaagcc

SEQ ID NO: 113749 - DNA, 561 bp, Homo sapiens
  Payload ID: 2224
  Gene Symbol: CAMKV
  Gene Name: CaM kinase-like vesicle-associated
  ENST ID: ENST00000480398
  CDS Start-End: 193-561
tgcgaatccggtgccggcaagcggctggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgaccccagaggtggtaggccggcagcggtatggacgccctgtggactgctgggccattggagtcatcatgtacatcct

SEQ ID NO: 113750 - DNA, 1688 bp, Homo sapiens
  Payload ID: 2224
  Gene Symbol: CAMKV
  Gene Name: CaM kinase-like vesicle-associated
  ENST ID: ENST00000467248
  CDS Start-End: 351-1631
gatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggagtgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatga

SEQ ID NO: 113751 - DNA, 1589 bp, Homo sapiens
  Payload ID: 2224
  Gene Symbol: CAMKV
  Gene Name: CaM kinase-like vesicle-associated
  ENST ID: ENST00000487726
  CDS Start-End: 161-445
gctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaagggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatga

SEQ ID NO: 113752 - DNA, 1475 bp, Homo sapiens
  Payload ID: 2224
  Gene Symbol: CAMKV
  Gene Name: CaM kinase-like vesicle-associated
  ENST ID: ENST00000466940
  CDS Start-End: 167-1450
ggcgatgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctgaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggca

SEQ ID NO: 113753 - DNA, 1035 bp, Homo sapiens
  Payload ID: 2224
  Gene Symbol: CAMKV
  Gene Name: CaM kinase-like vesicle-associated
  ENST ID: ENST00000466535
  CDS Start-End: 163-594
atgctggaggttcgctagccgaagcggctgcatctggcgccgcgtctgccccgcgtgctcggagcggattctgcccgccgtccccggagccctcggcgccccgctgagcccgcgatcacttcctccctgtgaccaaccggcgctgcaggttagagcctggcaatgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctggccccagaggtggtaggccggcagcggtatggacgccctgtggactgctgggccattggagtcatcatgtacatcctgctttcaggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattg

SEQ ID NO: 113754 - DNA, 1485 bp, Homo sapiens
  Payload ID: 2224
  Gene Symbol: CAMKV
  Gene Name: CaM kinase-like vesicle-associated
  Uniprot ID: Q8NCB2
  ENST ID: ENST00000620470
  CDS Start-End: 1-1422
atgccgtttgggtgtgtgactctgggcgacaagaagaactataaccagccatcggaggtgactgacagatatgatttgggacaggtcatcaagactgaggagttttgtgaaatcttccgggccaaggacaagacgacaggcaagctgcacacctgcaagaagttccagaagcgggacggccgcaaggtgcggaaagctgccaagaacgagataggcatcctcaagatggtgaagcatcccaacatcctacagctggtggatgtgtttgtgacccgcaaggagtactttatcttcctggagctggccacggggagggaggtgtttgactggatcctggaccagggctactactcggagcgagacacaagcaacgtggtacggcaagtcctggaggccgtggcctatttgcactcactcaagatcgtgcacaggaatctcaagctggagaacctggtttactacaaccggctgaagaactcgaagattgtcatcagtgacttccatctggctaagctagaaaatggcctcatcaaggagccctgtgggacccccgagtatctgggcaatccacctttctatgaggaggtggaagaagatgattatgagaaccatgataagaatctcttccgcaagatcctggctggtgactatgagtttgactctccatattgggatgatatttcgcaggcagccaaagacctggtcacaaggctgatggaggtggagcaagaccagcggatcactgcagaagaggccatctcccatgagtggatttctggcaatgctgcttctgataagaacatcaaggatggtgtctgtgcccagattgaaaagaactttgccagggccaagtggaagaaggctgtccgagtgaccaccctcatgaaacggctccgggcaccagagcagtccagcacggctgcagcccagtcggcctcagccacagacactgccacccccggggctgcaggtggggccacagctgcagctgcgagtggagctacctcagcccctgagggtgatgctgctcgtgctgcaaagagtgataatgtggcccccgcagaccgtagtgccaccccagccacagatggaagtgccaccccagccactgatggcagtgtcaccccagccaccgatggaagcatcactccagccactgatgggagtgtcaccccagccactgacaggagcgctactccagccactgatgggagagccacaccagccacagaagagagcactgtgcccaccacccaaagcagtgccatgctggccaccaaggcagctgccacccctgagccggctatggcccagccggacagcacagccccagagggcgccacaggccaggctccaccctctagtaaaggggaagaggctgctggttatgcccaggagtctcaaagggaggaggccagctgagtaggcagcctggtgagggggggcaggggatgggcaggagggtgggagagtggatgaggggct

SEQ ID NO: 113755 - DNA, 7588 bp, Homo sapiens
  Payload ID: 2225
  Gene Symbol: CREB1
  Gene Name: cAMP responsive element binding protein 1
  Uniprot ID: P16220
  ENST ID: ENST00000353267
  CDS Start-End: 232-1215
gcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactc

SEQ ID NO: 113756 - DNA, 7650 bp, Homo sapiens
  Payload ID: 2225
  Gene Symbol: CREB1
  Gene Name: cAMP responsive element binding protein 1
  Uniprot ID: P16220
  ENST ID: ENST00000432329
  CDS Start-End: 252-1277
tgtttccgtgcgcggccgctgcgcactcggcactgggcggcgctggctggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaactgaacgacaaagcatggtatttgaattttaaattaaagcaaagtaaataaaagtacaaagcatattttagttagtactaaattcttagtaaaatgctgatcagtaaaccaatcccttgagttatataacaagatttttaaataaatgttattgtcctcaccttcaaaaatatttatattgtcactcatttacgtaaaaagatatttctaatttactgttgcccattgcacttacataccaccaccaagaaagccttcaagatgtcaaataaagcaaagtgatatatatttgtttatgaaatgttacatgtagaaaaatactgattttaaatattttccatattaacaatttaacagagaatctctagtgaattttttaaatgaaagaagttgtaaggatataaaaagtacagtgttagatgtgcacaaggaaagttattttcagacatatttgaatgactgctgtactgcaatatttggattgtcattcttacaaaacatttttttgttctcttgtaaaaagagtagttattagttctgctttagctttccaatatgctgtatagcctttgtcattttataattttaattcctgattaaaacagtctgtatttgtgtatatcatacattgttttcaataccacttttaattgttactcattttattcactaagctcgataaatctaacagttactcttaaaaaaaaaaaaaaaagactaaggtggattttaaaaattggaaactgacataatgttaggttataatttctcatttggagccgggcgcagtggctcacgcctgtaatcccagcactttgggaggccaaggtgggtggatcacctgtggtcaagagttcaagaccagcctggccatcatggtgaaaccccatctctactaaaaatacaaaaattagccaggcgtggtggctggcgcctgtaatcccagctactcaggaggttgaggcagcagaattgcttgaacccaggaggcagagggttgcagtgagccgagatagcaccattgcactccagcctgggcgactccatctcaaaaaataaaaataaaaaaaatgtctcatttgggaaggaaattccttttaaaaaagagttgagacacttagaaaactaatgttttatatttagtcaagagttatttaagaaagtcaagcttgtttaacaacaaaatatgaagatttaagtgttaattgctggatccattttaaaataagattttaattaacatttgtaaatggtatattttcgtttgtaacaaaccattgtcttttttcaaggatgaacagagtttatgaaggagcatcattctaagaattaagtgatgtagtctttatgtttggacagttcaccagattctcaagaaggctttcaaacaactataaagtttgatgtttgtcctgctgagctaatggggaaagttatagcataaaaattgtgtaaccgcatagatatgtcatttttaaaaactggtttaacagaaatcaagcaaagtcacaaatatgttcacaagttggaattatttattgagtcaaaatgtcgaatcgaacattttgaatgaagtaagtgttataaatgaaaaattgcctgatgtttagcagtttgtattctctaaagctttttttcaaaagttcaggctttctacttactgggaagttggtggtcctcttagtccctgataaatcaaggcaatcacattcatgtgagctggatgaatttataagttataaagaccttatccttcataccttgaggatgattgcactggttttgaagtcagttgcttaatgatgaggtgagaaatgtatcctgttgctaaatctgtcttagacccttggtgaaacttgaagatttcagtttataaagataaaatcaagcatcttttgtgcagttttctttttttaatgcaagaatggtggggaggtttgtttgtaagcatgaaactttgagaatctttattaagaaaatgacataatttttaaaaaccttgtagccaagaacatatgtggccacattaccagtaataaatgtttttctctttatattggccaaaagggaataaaaatgtcatcataggaatttgtacatatgctactgatttgcctagaaaatagcaagtttgatattgctcactttgcaaatatagggccatgtggcacttttatctataggacagattaataaaaatgaagtggggaggggtttatttttgatatattactcttatgagttttcaagctttgataatgtttaactgaaaagtggcttagaaagggctagatccaatgtgttcattattaaataattgctatcagatacaattttaagttcattctttttcaaactcaagtaccatattggcaaccataatattgtcataggtgctctcttcatttagatattcttggggggggtggcatttgtataatatatgtgtacatatatatatatatatatatatatacatacagtatataatctaaagctctgagagctcttaagtcaggaatgctgagtattatagtatattgaggtcagatgaaattttacatttttgtgtgttctgttgcattccttctggtagtttctatgactgcattactccagcactcatgattgattttatcttctaattttcttccaagtattttattttttattagttttctttggcttgatacttttaaatatgttactagtcacttgaaagcctctcccccaaaagtatttggtttgtatgctttgtctgtggcagctataacagtggtaagaacattttgaagatagctttttaaaggaaccactgattttttcaaaaatcatcctgggggaggaattttggcatttcatttgagcagggattttgtcagaaaatgtgttttgatggtaggtcagcagcagtgctagtctctgaaagcacaataccagtcaggcagcctatcccatcagatgtcatctggctgaagtttatctctgtctctcaggataaatccctgtaggacaaatccctactatcatttctaccttttggggtgacatgtggaatcatacaaaggcttaggaagaaatacgtttgtttaaaccaggatgctttacttacttgaagtgacttcaatctagatttcttttaatatttaacaaatttttaattctatgatcagccacagtcagctattaccataaattggtctctgtttattttgaagatcacggctgcttcattttgcaggattaagtagggctaatgtatcttaaagttaagatcttgaattaaagtgagttttagaaatagtgttacataccttttcagttgttttcaagaggctttatttttgttgcctttgtagccctgaaagctgttggtatattttttccctcatggacccaatagaaaagttgtatatttatttggattatatttacattctgtcctttgtaaatgtttggtgtaacttgcacttttttaaatgacccagtttgggtattagcaacttaagaaattccctcatcaagtaattctcaactttttagtctttctcctctcttcaaatcatgtgactttttaaatggaagtttttcattgattaaaatattttagcacctaaaagctagccttaaaaacagctgtaaaagaaaaacatcaggaaattagatatgactagcccagttaattaaaagacgggctcaaaccttgttttattctttttcatcttggatgaagattgaagggaaaataactcaagtgcataatatttattttcaatttttaatgagactttatcctcatcacaacattaatactgtacatagtatgccaaaatatccattaatttgtctagaatagtacaagactttttaaagcaattgtcctcacagagaccacatgtaatatactgaaatatgttcatttttaatggctttgttaacatcaaagaaatgctgcctaaatttgatttcagatgaggaaggagaaagtaaagtgtgcatagtaaggctgtaggtgaagagttgtgagataaatagttcactcagttgtacaaagcacaactagaactttttgttgggaggcttacatacatcttgaatattcttaatgtaataatgttgactattaagttggctacacagtcactgtatgtactaggaactggtttccttgacattctagaatcaatggctaggagaggcattaatctttgaggggctgaacatatcatgaagctgagtcagtatggaaaattttcaaataaacagggtgctgaagttccatctgtctcatctgcttatgataagttcttattgattagtgaatgtagcttaagcctttgtatgtgtcctcagggggcagaccgactttaagagggaccagataacgtttgaatggagggattatatttcaggtgttttagcttgaaatttattttttaaaaaaagaaaaatttaaaaaatatataaataaaatagaacaaagccggtgatgcaagttgatattataaacaggcagttttagcacagaaagaaaatactgacctgtctgcattctggtacggtgggtgcaggtcccagctgggtatgacatgatacatttttaattattctcaccagcaagtaaaaggaaaatgaacaatcttttggaattgtctttgaaaaggatcaaagagtaggaaattcacatttgacctaacattacttgcctatagaagtatggcatttccaagcttttgtctgaggagcatctcagagaagtgagagtaaatctgagttagcttaaaaattggtagggaggaagaaaatctctgcaaataatgattttatgtttgttggccaagtgaaatgatctatcattgtgtttgggaggttttattttcttatgtttttaaaattggtaaatgctttatagatgtatttttatccaagtgccactccaatttgtgtatgtaataaaattatttatattaaaagtgggaaataattgtcaacattttttttgagtatagatttattaggggtggcaaagaagagtgctagttagcagttttccatgtaaagttgtccttgactgatttgtccacatgtcagttgtaactcccccactccctgcaaaaggaattatttctaacccagatgtatcacttgaaactttttagaagcaaaataatcagggaagttcctagaaaggtgtttggctttttggtttttgagggttggggtaaagaagacttcccccacaactgtcagcacaaaacagggtattgatttttaactctgatgtttctattggagttgaatactaaataaataactataatgagggaaatacatttctaataaaattccctacattctagaaacatccctgttttaatttttttatctaaatctttttgtgctttatgtgtaaagaaaaaaatgtactgagttacaatgcattttattaacactatgtacataatagctgctttgtgttcagaatagtagcagttgctttgtatattaaagtgatccttgtgaatttgtgaaatattgtcataaagtgctttttcttactgtaatctttgtggtatcaactgtcataatgctctttttacacaaacatttatgtgcagtcacataaacatgcttttaaaaactc

SEQ ID NO: 113757 - DNA, 430 bp, Homo sapiens
  Payload ID: 2225
  Gene Symbol: CREB1
  Gene Name: cAMP responsive element binding protein 1
  ENST ID: ENST00000457101
  CDS Start-End: 37-430
tctgtgcttgaaattctgtgactcttccctgtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaa

SEQ ID NO: 113758 - DNA, 518 bp, Homo sapiens
  Payload ID: 2225
  Gene Symbol: CREB1
  Gene Name: cAMP responsive element binding protein 1
  ENST ID: ENST00000452474
  CDS Start-End: 122-518
gaaagcagtgacggaggagcttgtaccaccggaactgttggggacacagtgactaaggcaaaatatgtgtcaaaagaaagcagtcaaaggaaaaagggatcacctttggtgaagtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggcctt

SEQ ID NO: 113759 - DNA, 730 bp, Homo sapiens
  Payload ID: 2225
  Gene Symbol: CREB1
  Gene Name: cAMP responsive element binding protein 1
  ENST ID: ENST00000455757
  CDS Start-End: 1-423
ggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacaggtacaaatactgcatttacttagattgttatgtgttaagtgtgtcttcacattctgctggatgtgtatctttacatctactggtaataggatctttgcattgaattttttttttccagcagaattaatggatcttgctaaattttctttatttaataagctgcacttataagatagctgtatgattatgggtcaatctttgatcgtggagtagttttctttcatgcagtttccccacaggagatttaatgcacaacttccctatgtctgcactccaaccagttagccaggttatttaaaaatggtttcttttcatgtatagtattgttcaagaagatcaagagtttcatatatgtatattaactgtgtgttaaattttatctatattaaatttacttgatataaagtaaa

SEQ ID NO: 113760 - DNA, 713 bp, Homo sapiens
  Payload ID: 2225
  Gene Symbol: CREB1
  Gene Name: cAMP responsive element binding protein 1
  ENST ID: ENST00000421139
  CDS Start-End: 202-713
ggctccctggctgcggctcctcagtcggcggcggctgctgctgcctgtggcccgggcggctgggagaagcggagtgttggtgagtgacgcggcggaggtgtagtttgacgcggtgtgttacgtgggggagagaataaaactccagcgagatccgggccgtgaacgaaagcagtgacggaggagcttgtaccaccggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatactgcctctggagacgtacaaacataccagattcgcacagcacccactagcactattgcccctggagttgttatggcatcctccccagcacttcctacacagcctgctgaagaagcagcacgaaagag

SEQ ID NO: 113761 - DNA, 580 bp, Homo sapiens
  Payload ID: 2225
  Gene Symbol: CREB1
  Gene Name: cAMP responsive element binding protein 1
  ENST ID: ENST00000414681
  CDS Start-End: 344-580
gaattcaggaggagttgcccacttgttagtgtgcagggaaatgtgtttttctcatttctagttgaggtcattctttttttttttttttttttaaaccatagcatgtgttccattagttatgaatgtattatttctttagagtcaaaattcacaactcatttctttgaatattatctctgatcctagatgggatcaaaattgccctagatttaggagttttaaaagtttactaggttgtggggaagatgggtttatttttcataaacttgaactagaatgttgacgattataaggactgggacacttcctaaaggtcaaaatattttaaggcgaaagtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcag

SEQ ID NO: 113762 - DNA, 2005 bp, Homo sapiens
  Payload ID: 2225
  Gene Symbol: CREB1
  Gene Name: cAMP responsive element binding protein 1
  Uniprot ID: P16220
  ENST ID: ENST00000430624
  CDS Start-End: 291-1274
agaccactcctcccggcgccgggctcagcccgccttcgccttccctctccccgcggaaccccttctcgtcgcccgaagaaacccgaaggtcttcggcaagttccgtccccagcgcgggggcggggccgctcgagctgctccgggcctagctcggctgtttccgtgcgcggccgctgcgcactcggcactgggcggcgctggctggctccctggctgcggctcctcagtcggcggcggctgctgctgcctgtggcccgggcggctgggagaagcggagtgttggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaagaatatgtgaaatgtttagaaaacagagtggcagtgcttgaaaatcaaaacaagacattgattgaggagctaaaagcacttaaggacctttactgccacaaatcagattaatttgggatttaaattttcacctgttaaggtggaaaatggactggcttggccacaacctgaaagacaaaataaacattttattttctaaacatttctttttttctatgcgcaaaactgcctgaaagcaactacagaatttcattcatttgtgcttttgcattaaactgtgaatgttccaacacctgcctccacttctcccctcaagaaattttcaacgccaggaatcatgaagagacttctgcttttcaacccccaccctcctcaagaagtaataatttgtttacttgtaaattgatgggagaaatgaggaaaagaaaatctttttaaaaatgatttcaaggtttgtgctgagctccttgattgccttagggacagaattaccccagcctcttgagctgaagtaatgtgtgggccgcatgcataaagtaagtaaggtgcaatgaagaagtgttgattgccaaattgacatgttgtcacattctcattgtgaattatgtaaagttgttaagagacataccctctaaaaaagaactttagcatggtattgaaggaattagaaatgaatttggagtgctttttatgtatgttgtcttcttcaatactgaaaatttgtccttggttcttaaaagcattctgtactaatacagctcttccatagggcagttgttgcttcttaattcagttctgtatgtgttcaacatttttgaatacattaaaagaagtaaccaact

SEQ ID NO: 113763 - DNA, 829 bp, Homo sapiens
  Payload ID: 2225
  Gene Symbol: CREB1
  Gene Name: cAMP responsive element binding protein 1
  ENST ID: ENST00000448277
  CDS Start-End: 75-829
atgtgtgctgtttctctttgcttttgccactactccactctgtgcttgaaattctgtgactcttccctgtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaaga

SEQ ID NO: 113764 - DNA, 651 bp, Homo sapiens
  Payload ID: 2225
  Gene Symbol: CREB1
  Gene Name: cAMP responsive element binding protein 1
  ENST ID: ENST00000445803
  CDS Start-End: 105-651
actgggcggcgctggctggctccctggctgcggctcctcagtcggcggcggctgctgctgcctgtggcccgggcggctgggagaagcggagtgttggtaactaaatgaccatggaatctggagccgagaaccagcagagtggagatgcagctgtaacagaagctgaaaaccaacaaatgacagttcaagcccagccacagattgccacattagcccaggtatctatgccagcagctcatgcaacatcatctgctcccaccgtaactctagtacagctgcccaatgggcagacagttcaagtccatggagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtata

SEQ ID NO: 113765 - DNA, 893 bp, Homo sapiens
  Payload ID: 2225
  Gene Symbol: CREB1
  Gene Name: cAMP responsive element binding protein 1
  ENST ID: ENST00000418081
  CDS Start-End: 1-545
gagtcattcaggcggcccagccatcagttattcagtctccacaagtccaaacagttcagtcttcctgtaaggacttaaaaagacttttctccggaacacagatttcaactattgcagaaagtgaagattcacaggagtcagtggatagtgtaactgattcccaaaagcgaagggaaattctttcaaggaggccttcctacaggaaaattttgaatgacttatcttctgatgcaccaggagtgccaaggattgaagaagagaagtctgaagaggagacttcagcacctgccatcaccactgtaacggtgccaactccaatttaccaaactagcagtggacagtatattgccattacccagggaggagcaatacagctggctaacaatggtaccgatggggtacagggcctgcaaacattaaccatgaccaatgcagcagccactcagccgggtactaccattctacagtatgcacagaccactgatggacagcagatcttagtgcccagcaaccaagttgttgttcaaggtactcaaaaattgtaaagcaggatgtcagtgaatttgaattctgaacgtcagtttgaagatgagtctacttgaaattttttaatatgaatttaccaatatcaaaggaagacactgaggactatactctatctaggaagatcatccaagctgtgccccacttaccttttagacttaagctgcctctggagacgtacaaacataccagattcgcacagcacccactagcactattgcccctggagttgttatggcatcctccccagcacttcctacacagcctgctgaagaagcagcacgaaagagagaggtccgtctaatgaagaacagggaagcagctcgagagtgtcgtagaaagaagaaaga

SEQ ID NO: 113766 - DNA, 1832 bp, Homo sapiens
  Payload ID: 2226
  Gene Symbol: CREB3
  Gene Name: cAMP responsive element binding protein 3
  Uniprot ID: O43889
  ENST ID: ENST00000353704
  CDS Start-End: 439-1554
gcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctg

SEQ ID NO: 113767 - DNA, 1919 bp, Homo sapiens
  Payload ID: 2226
  Gene Symbol: CREB3
  Gene Name: cAMP responsive element binding protein 3
  ENST ID: ENST00000613913
  CDS Start-End: 454-1638
ggaagcgagggtgcggcgcaatccggagaggacgccaggacgacgcccgagttccctttcaggctagaactcttcctttttctagcttggggtagaaggcggagccggagccccggaacccccgccctcggggtgcgaggcggcagcagggccgtcccctacatttgcatagcccctgggacgtggcgctgcacccaagcctcttctcagttggagggaactccaagtcccacagtgccacggggtggggtgcgtcactttcgctgcgttggaggctgaggagaattgagcctgggaggcgggtccggagagggctatggaaagccgccggcggggaatcccggccgtagagggacagtggataggtgcccgaggcctacagctggcctggggctcgtgtctgggcttcggacgttggggcccggtggcccaccctttccgtagttgtcccaaatggagctggaattggatgctggtgaccaagacctgctggccttcctgctagaggaaagtggagatttggggacggcacccgatgaggccgtgagggccccactggactgggcgctgccgctttctgaggtaccgagcgactgggaagtagatgatttgctgtgctccctgctgagtcccccagcgtcgttgaacattctcagctcctccaacccctgccttgtccaccatgaccacacctactccctcccacgggaaactgtctctatggatctaggtgagtctgaaataagtttggggaggacagggttcatgggcctggctattcatactttcccttttgcagagagtgagagctgtagaaaagaggggacccagatgactccacagcatatggaggagctggcagagcaggagattgctaggctagtactgacagatgaggagaagagtctattggagaaggaggggcttattctgcctgagacacttcctctcactaagacagaggaacaaattctgaaacgtgtgcggaggaagattcgaaataaaagatctgctcaagagagccgcaggaaaaagaaggtgtatgttgggggtttagagagcagggtcttgaaatacacagcccagaatatggagcttcagaacaaagtacagcttctggaggaacagaatttgtcccttctagatcaactgaggaaactccaggccatggtgattgagatatcaaacaaaaccagcagcagcagcacctgcatcttggtcctactagtctccttctgcctcctccttgtacctgctatgtactcctctgacacaagggggagcctgccagctgagcatggagtgttgtcccgccagcttcgtgccctccccagtgaggacccttaccagctggagctgcctgccctgcagtcagaagtgccgaaagacagcacacaccagtggttggacggctcagactgtgtactccaggcccctggcaacacttcctgcctgctgcattacatgcctcaggctcccagtgcagagcctcccctggagtggccattccctgacctcttctcagagcctctctgccgaggtcccatcctccccctgcaggcaaatctcacaaggaagggaggatggcttcctactggtagcccctctgtcattttgcaggacagatactcaggctagatatgaggatatgtggggggtctcagcaggagcctggggggctccccatctgtgtccaaataaaaagcggtgggcaagggctggccgcagctcctgtgccctgtcaggacgactgagggctcaaacacaccacacttaatggctttctgggtcttttatttgtacccatgtgtctgtcacaccatgaatgtacctggggaaatcaactgacctccctgaacatttcacgcagtcagggaacaggtgaggaaagaaataaataagtgattctaatgctgcct

SEQ ID NO: 113768 - DNA, 561 bp, Homo sapiens
  Payload ID: 2227
  Gene Symbol: CREB3L1
  Gene Name: cAMP responsive element binding protein 3-like 1
  ENST ID: ENST00000534787
  CDS Start-End: 245-561
ggcgcgctgaggctgcttctggtcagggaaaccattctcctacaccgaccccagcaggcagctgcgcccccagagctttaccctgtctctgcactgaccttggggaaggaatttagggaggggtaaaacaaggctagagctggtaccattactgccccgggagagtcccctctgccgccaccagagacagccaccaaagcgccccacgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgc

SEQ ID NO: 113769 - DNA, 528 bp, Homo sapiens
  Payload ID: 2227
  Gene Symbol: CREB3L1
  Gene Name: cAMP responsive element binding protein 3-like 1
  ENST ID: ENST00000530518
  CDS Start-End: 1-372
atctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacagcttctccagcgggatccagccactcctctgttccctgattggcctggagaatcccacctgaccccccaccccacccctctgtctctggctggggttcctttctggcccaaagtaggtccaagcccttgtagttatttcgccacctgctgtacattgtgggaactgcaacccctacgtgcccgtttgggtggagagagattaaacatttgcccaccaa

SEQ ID NO: 113770 - DNA, 2687 bp, Homo sapiens
  Payload ID: 2227
  Gene Symbol: CREB3L1
  Gene Name: cAMP responsive element binding protein 3-like 1
  Uniprot ID: Q96BA8
  ENST ID: ENST00000621158
  CDS Start-End: 452-2011
cagagaggaaagtgacagaagacgtgcggagggagacgcagagacagaggagaggccggcagccacccagtctcgggggagcacttagctcccccgccccggctcccaccctgtccggggggctcctgaagccctcagccccaaccccgggctccccatggaagccagctgtgccccaggaggagcaggaggaggtggagtcggctgaatgcccacggtgcgcccggggcccctgagcccatcccgctcctagccgctgccctaaggcccccgcgcgccccgcgccccccacccggggccgcgccgcctccgtccgcccctcccccggggcttcgccccggacctgccccccgcccgtttgccagcgctcaggcaggagctctggactgggcgcgccgccgccctggagtgagggaagcccagtggaagggggtcccgggagccggctgcgatggacgccgtcttggaacccttcccggccgacaggctgttccccggatccagcttcctggacttgggggatctgaacgagtcggacttcctcaacaatgcgcactttcctgagcacctggaccactttacggagaacatggaggacttctccaatgacctgttcagcagcttctttgatgaccctgtgctggatgagaagagccctctattggacatggaactggactcccctacgccaggcatccaggcggagcacagctactccctgagcggcgactcagcgccccagagcccccttgtgcccatcaagatggaggacaccacccaagatgcagagcatggagcatgggcgctgggacacaaactgtgctccatcatggtgaagcaggagcagagcccggagctgcccgtggaccctctggctgccccctcggccatggctgccgcggccgccatggccaccaccccgctgctgggcctcagccccttgtccaggctgcccatcccccaccaggccccgggagagatgactcagctgccagtgatcaaagcagagcctctggaggtgaaccagttcctcaaagtgacaccggaggacctggtgcagatgcctccgacgccccccagcagccatggcagtgacagcgacggctcccagagtccccgctctctgcccccctccagccctgtcaggcccatggcgcgctcctccacggccatctccacctccccactcctcactgcccctcacaaattacaggggacatcagggccactgctcctgacagaggaggagaagcggaccctgattgctgagggctaccccatccccacaaaactccccctcaccaaagccgaggagaaggccttgaagagagtccggaggaaaatcaagaacaagatctcagcccaggagagccgtcgtaagaagaaggagtatgtggagtgtctagaaaagaaggtggagacatttacatctgagaacaatgaactgtggaagaaggtggagaccctggagaatgccaacaggaccctgctccagcagctgcagaaactccagactctggtcaccaacaagatctccagaccttacaagatggccgccacccagactgggacctgcctcatggtggcagccttgtgctttgttctggtgctgggctccctcgtgccctgccttcccgagttctcctccggctcccagactgtgaaggaagaccccctggccgcagacggcgtctacacggccagccagatgccctcccgaagcctcctattctacgatgacggggcaggcttatgggaagatggccgcagcaccctgctgcccatggagcccccagatggctgggaaatcaaccccggggggccggcagagcagcggccccgggaccacctgcagcatgatcacctggacagcacccacgagaccaccaagtacctgagtgaggcctggcctaaagacggtggaaacggcaccagccccgacttctcccactccaaggagtggttccacgacagggatctgggccccaacaccaccatcaaactctcctaggccatgccaagacccaggacataggacggacccctggtacccagaagaggagttcttgctcactaacccggatccgcctcgtgcccctgcctcctggagcttcccattccaggagaaaaggctccacttcccagcccttccttgcccctgacatttggactcttcccttgggccgaccactctgttctcattctccttcccaccaacatccatccgtccttctcagacaaaccactcactgggtaccccacctcctctctcatatgcccaacacgaccactgcctccctgcccccacacctgcacccaaacagacacatcaacgcaccccactcacagacaccccttaccccacccccactgtacagagaccaagaacagaaattgtttgtaaataatgaaccttattttttattattgccaatcccctaagatattgtattttacaaatctccctcttcccttcgcccctcccttgttttatattttatgaagttagtgcgggctttgctgctccctggcccaggaaagagggactacctgaccctcacctggcacccccctgctgctgcccaagccgctgggcctttttaattgccaaactgctctcttcatcagctcagcacatgctttaagaaagcaaaaccaaaaaaaaaaaaaaaaagatgcagcatcaa

SEQ ID NO: 113771 - DNA, 7412 bp, Homo sapiens
  Payload ID: 2228
  Gene Symbol: CREB3L2
  Gene Name: cAMP responsive element binding protein 3-like 2
  Uniprot ID: Q70SY1
  ENST ID: ENST00000330387
  CDS Start-End: 353-1915
gtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagtaa

SEQ ID NO: 113772 - DNA, 776 bp, Homo sapiens
  Payload ID: 2228
  Gene Symbol: CREB3L2
  Gene Name: cAMP responsive element binding protein 3-like 2
  ENST ID: ENST00000458726
  CDS Start-End: 216-773
gatgggcccactctggcccgatcctggcaccagcaatgggatgttgacctgtctgctgagtcttggagcccaccactgccaaggacacccagctggagctaatttgctgggctgagtcatagcatctgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaa

SEQ ID NO: 113773 - DNA, 719 bp, Homo sapiens
  Payload ID: 2228
  Gene Symbol: CREB3L2
  Gene Name: cAMP responsive element binding protein 3-like 2
  ENST ID: ENST00000420629
  CDS Start-End: 1-719
aaccttccccgacgtccccggcgcctctcatccaggctgagcacagctactccctgtgcgaggagcctcgggcccagtcgcccttcacccacattaccaccagtgacagcttcaatgacgatatgttacataaatagtaaatggatgtacggtccgccctccctgtgcttgggttttgcatcctatgaatactgtattttcaatccacgtttatttgaaaaaaatctgcttgtgagtggacccgcatggttcaaaacccgtgttgttcaaggaccaactgcgtatgtgtttttctcatatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttc

SEQ ID NO: 113774 - DNA, 2360 bp, Homo sapiens
  Payload ID: 2228
  Gene Symbol: CREB3L2
  Gene Name: cAMP responsive element binding protein 3-like 2
  Uniprot ID: Q70SY1
  ENST ID: ENST00000456390
  CDS Start-End: 363-1745
gtccctcaaagtttgtgtctggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtgggtaagacagcatgtggcaagttgggcagggtcttgttttatttccctagagctgggtttctcagtcttccaaaaggaatcttctgtgaaagtccaatgtttaaaaagtggtaaaagtggagcttctccctttgaagaggcaagtgggggttcccctggggcccctcatccactggactgcggcatcactgggaattctccagagcttgacagagcacagtttgcaaactgctgttctagactgtgttccctgatccattctgacatctaatttttgagttctgataagggagagggaagcagatgagggaaagagtctgtcgctttctgtgacgttttaagagaactgctgtgtttctgcctccactgagtggaattgtatgagtaatgtaatgcaatgtatatagtaagggcttgtaaagtgaaattaaataaacagcaaggtcagggccgggcgtggtggctcacgcctgtaaccccagcactttgggaggccgaggcgggcagatcacgaggtcaggagattgagactatcctggctaacactgtgaaaccccatcgccactaaaaaatacaaaaaaattagccgggcgtggtggcaggtacctgtagtcccagctactggggaggctgaggcaggagaatattgtgaacctgggaggcggagtttgcagtgagccgagatcgcaccactgcactccagcctagacgacagagcgagactccatc

SEQ ID NO: 113775 - DNA, 1105 bp, Homo sapiens
  Payload ID: 2228
  Gene Symbol: CREB3L2
  Gene Name: cAMP responsive element binding protein 3-like 2
  Uniprot ID: Q70SY1
  ENST ID: ENST00000452463
  CDS Start-End: 343-1089
ggagccgtagcggcaagtgggcttgcggctaagggattttcctgggatgagagcgggtcttctgccttcattttggatgcacatcccgctttagccccggcagcctttggtccggctcgtgtccctggggattctcggatctccgaggacaccggacgggagcgcttggccatcctctctccggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaaggtctgtctgccctccctgtgtccctttgggttatggatatggtctctgggtctacagagagggaatatggcgagagagctgggatgagtttgtaccacagatgttgtagctggctttatgaaatagctctgttcttaaaaaataaaaattttgcttccaaataaaaattttgcaagctaa

SEQ ID NO: 113776 - DNA, 7133 bp, Homo sapiens
  Payload ID: 2228
  Gene Symbol: CREB3L2
  Gene Name: cAMP responsive element binding protein 3-like 2
  ENST ID: ENST00000616381
  CDS Start-End: 123-575
acagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatctgtcactctgaccatcacagccatctccaccccgttggaaaaggaggaacctcctctggaaatgaacactggggttgattcctcgtgccagaccattattcctaaaattaagctggagcctcatgaagtggatcagtttctaaacttctctcctaaagaagccccagtggaccacctgcatttgccgcccacccctccgagcagtcacggcagtgactcagagggcagcctgagtcccaacccacgcctgcaccccttcagcctgcctcagacccacagcccctccagagctgcaccccgggccccctccgccctctccagctcccctctcctcacggctcctcataaactgcagggatcaggccctctggtcctgacagaggaggagaagaggaccctgatcgctgagggctatcccatccccaccaaattgcccctgtcaaaatcagaggagaaggccctgaagaaaattcggaggaagatcaagaataagatttctgctcaggaaagtaggagaaagaagaaagaatacatggacagcctggagaaaaaagtggagtcttgttcaactgagaacttggagcttcggaagaaggtagaggttctagagaacactaataggactctccttcagcaactccagaagcttcagactttggtgatgggcaaggtttctcgaacctgcaagttagctggcacgcagactggcacctgcctcatggttgtggtgctgtgctttgccgttgcattcggcagcttctttcaaggctacgggccctatccttctgccaccaagatggctctgcccagccagcattccctgcaggagccctacacagcctccgtggtgagatccagaaacctgctgatctacgaggaacattctcccccagaggagtcatccagcccgggctcggctggggagctggggggctgggatagaggttcctccctgctcagggtgtcagggctggagtccaggccggatgtggatcttccccatttcattatctcgaatgagaccagcctggagaagtcagtgcttttggagctgcagcagcacctggtcagcgccaaactggaggggaatgaaacactaaaagttgtagaactcgacagaagagtgaacaccactttctaaagaggctgcctgcaccccctccctttcccttaactctacttttacatccccaaaccacctttgtcatcagcttttcctctttgccactggatcttcatggagacatgggcaagcattagtggcttcagattggagaccagcctgggacttccctgcagtgagagagcatctccccctggtccatgcccctcctgtgcagaagggagcctgcatccctcccttcctttctcttactgccataggaaattattttaggggttggaggtgggacaagcaggcttgtttccaccaatagtgccaaaaagatattgcctaatgtgcacctgtgaggtgtaaccccccgctttggagacgagatggctcttgttcagtcaagaccccagactctggccacaaaaatgccataatgcctgttggtatttggcaaagcactgacccgtgtcctccgttgctcgcactggggtctctggtgtgaacacccccgacagcagccctccgcccactctgccccctgggagccctcgctggatcgtctcgtctcctgcagcagcactggcaggcgagggctctcgttcatattctcaggccgcaagtgcaatgcctgaggggatcaggcttttctactccaggcaaacctgccccatcttgtcgcttttaggacctcccacaacctggttccccacacatccatagttctgcctccccagcttctcctccccagttgtaaatagtatttattagcttgccgaggcttcctgctagcaaccacactgaagagatcgatgcctcctttcaagctagccaagttttctgcgagccttcagagctaggagggcaccctaggctctgggatcccgtgtctttccagacaatgttttgtttcctttcctttgttttttcttttaactggaataattaccattgaaaaagaagttcctttgagcatgtatgtgtctgcctctaggatgagctcagagcgagagatgacacaatgcctcactcaggccccgggctccctggccacaagctttttctatcctgttttcatgacagagaaggggaagccctgttctgacaacagacatttcagacaaccttgctggctttccacacctgcctggccccctcctccctccacacttccactttgtcctcctcgtcccctacctcaacaaagcagggtggggtaggtgacatttgtgtatccacattcttacctttggtagtcaggtttggctactttgcagctcgcccaaagagatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattccatatcaggtacaggatttgatgttattaacatttgtcgtcatacctcataagtcggtccctgccttgtctgtctaggcccatttggggctccctgtgagtgattcccctctctctgctatgctggagacggttccagcctggaaagcggccaagttcatcttctcactgtgagtggaagctggatcgggcccccgtagtcctggcagccctgttgtctggagggttcttgttgtccctcccattagccagggcggagactgtctgagctgtgcaggaggagggttgctagtaggttctgcttctgcttctctctgctccactgtctgcagcccagatcctgttgggcctggctggtgtctggtaaccatgggcctccactgacccatccctctcttttaaactgtcaggtcattatcaggcataggcagcctatagggcccaaagaaggcaaaaagataagatttactcaagtagcatttgggcaatgaggaaggaaaggtttcaaatttaggggcagaagtgagagaatgagccaacccatgtacctgctgcaactgaaccagactgggttttcaaggctcccagacgtagagtaggaaacgtgctcttctaaatgaggagggagaagataaaggaaacttctagcccctgtccttagtgctttgaggattttattttctcccttactacgcttgcttgacgtcactctctctcgacctccaaacagcaggactctttctctgggaaaccatccttccaaaacggaatctatgtagacaatgggacgttaggcagagagctcagatggcccttttaagggggctccaagaaccaacatcactgctcttttagataaacctctgccctccactccttgcttgagtgggttaaaggaactaacagttgtccctttaggaggacaaaatggggtcaagaggacacagaagagttgtatagcaccagattggttccaaatagttaatggatgtgtgcacattttctgttcagggattaagaccagaatatcagtggatttgttttccccaccaagtggcctcttagactagtcattaacttatgattagctctaaagatttcaaatagtggcagacagtgtcttctgaatgtaagttttgagaaatacgagtctgtcagagcggccataagccataaagagtcaatctcttaattatatttttcatcatgtaaacaagtttcccatttccctttcttagattgcaccagtgaaggagatgttttgcaaagattcagagaactaatttttcactggataagacctgagtaacccagaccccccaccgtggttcttttcacagccctcgactttgcacttaaaaagggatattgtaaatgaaaggctgcagtgccagttttaagaaagaatttctgtgaagtgtgaggactctggagtctagctcacataaagagagtgttatataaaaatccgacagctgaactaggttgctcttttttggcagggagtggggatgagatttgacaccaatatgggcaaaattagataaccttttggttaatataaatgattttgatttggaggcctaatttgtagattgtgaaagcagcttttagtttaacttattcacagaccccttataattaccatgtttttttttttcttcctaaatctcttggttcagcttgtgaatcttacgtgcccgtaaagttgggatgttgaattggctcttctttgttctggcagtgagtcaagtgtccagcattttttcataagtgttttttaaaattgttctccagcattttatggctcctccctcccatgtcctcagacccagcaaaagcgtagaggcagaattagaggcctctccaggccagctcctctgcccacatgtcatacaaggtgtgaatttgagcacagtccagaaatggagacatcccacccccagttgaataatggcccattcatgccaaccttgccaacacggagagggcagagatgcactagaagaccttcatcctccccttcctctgccccaagtcactacagttggttctattgaagccagtctttaagaaacctgggttaaagacaccagcacttctgcttgctgggctggctggacctgtgaagccatgggcaggtagtgccctcttgagagtcattttatttggccaccttcaggtgagactatccatagacacatgctaggataggccccgctgggagggcagttacaggagagagtaggtggtggtgacgtgagggctgtgaaggatccagagacaagacttagatgtttcgttcattcactcactcattcagttactcctaagacttttcagtttcataaggaagagtgttgcctgaggccctagggaatattggggaatagaagggattgaggaaacattaataatagttattcaaaagacccaaatgcttatacttctctctcccttcttctctctctgacacacacacacacacacacacacacacacacacacacgtgcacattcctcccttacatgctcatttgtgccttaaatgtgccttataggtaaatccaggatgactgaggaatccctcgtcactgggagattttgtatatattcttttattattagattgagttgggtgtggggaaaaatttttttctgaaggctcaaaagtggtttcctaaaagtgagccactatcagatttgcacatcaggagaaaagaaatagggttacgtccattaggaaaatcccagtttgcaggagtgcaatcacatcaaaaaaacaaccagccaggattaaaggtattataaatcctcatagcggaacatttctcagggcaaaggaacctggctcatttgaagattaatgttccatgcctttgtggtcaaagggtcagcacttaacacaggaaaaaactaggtgttgttttgttttgttattttggacaacataaaattcaggaatgttttatttagccttggtttctagaaggaagggaaataatatttcttgagcatttactagggtgttgcgtgctgtgctaagtaaattttaagtctttcagttttatagatacggaaaacaagggtgactctttaccacaggatgaataaagaactaagtaatatgggaaatgcagcaatttctggactagctgagccgattccttcctgtgagcacactgtaagctttcaagttctctgggcaggaattacagcacctgtcccctgcaatggccctgctgtgtgatgctcatcgcttcccttcgtgctggagcagtcccccaggtgtccatctcctatctttttgttccaatcttctgtgagttccagctagcaggctttacatctggggaaaggaaaaccaggggttttagctctgttctctgctcccatccttcgctcaccagctgagtgagaacatgaactttttgcaccatgtacccatggcttacactacttagaaaatcaccttttcagataaaacagtttatgagttcatagagaacaccagcactctttgacaaaactgtgagtgaccctttttaaacaatgctgagcaggccctgagctataatcaacggtgagctttaatgtctatgctgacagttaggttttgctctcttttgtaacaggttacgtagaccagcagtgtttaaatctaaatacgttgtgagtctgttatctgtcctatcgcgttttttaaatgactttttattctttatcatagctaagtaaataccaaaaaaaaaaaaaagctttgtaggacacttgtacttagtttgggaaaaaaaaataaattgaaattgttatgcttttgtatttccatttcttgcaaataaatattttttcttaaatagt

SEQ ID NO: 113777 - DNA, 1053 bp, Homo sapiens
  Payload ID: 2228
  Gene Symbol: CREB3L2
  Gene Name: cAMP responsive element binding protein 3-like 2
  ENST ID: ENST00000620715
  CDS Start-End: 162-689
cggcagaggagcagacgtttgctttccaagtgcaaaactacagacacgcgcgcgcacacacgcaagcacacgcggagagagaggaaccttgccggtccgaggcagctctgcgcgtcccctcctgcgcttagcatcctcggcccagcgcggcccgcaccgccatggaggtgctggagagcggggagcagggcgtgctgcagtgggaccgcaagctgagcgagctgtcagagcccggggacggcgaggccctcatgtaccacacgcacttctcagaacttctggatgagttttcccagaacgtcttgggtcagctcctgaatgatcctttcctctcagagaagagtgtgtcaatggaggtggaaccttccccgacgtccccggcgcctctcatccaggctgagcacagctactccctgtgcgaggagcctcgggcccagtcgcccttcacccacattaccaccagtgacagcttcaatgacgatgaggtggaaagtgagaaatggtacctgtctacagacttcccttcaacatccatcaagacagagccagttacagacgaaccacccccaggactcgttccgtctgtcactctgaccatcacagccatctccaccccgttggaaaaggaggaacctcctctggaaatgaacactggggttgattcctcgtgccagaccaatacaacctaatccccaacctacttttagtttttttgttttttttttatggttaaaagtaacttttgtagtttaaaaaaatctttcctctttcatataaataagaagtggaaattgcctttttattgtgtaatgtagaaaaccctcaagtgttttttccgagcttgggaaagattttgtgtaggaaatgtgcatagagtttgtattttatttttattagcagctgaaatgcctttggttttggcttctctctctccctctctctctctgtctctccttctctctctccccccaccacccacccccacacacgtcatctgcattgttattggagcctgtacttagagggattaagcccacaccctggcttccattc

SEQ ID NO: 113778 - DNA, 2618 bp, Homo sapiens
  Payload ID: 2229
  Gene Symbol: CREB3L3
  Gene Name: cAMP responsive element binding protein 3-like 3
  Uniprot ID: Q68CJ9
  ENST ID: ENST00000078445
  CDS Start-End: 148-1533
gtgaccgcttcagcatcttttgggagtggtgacagagccacagagggctgtgagcttgcccggccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcaacagcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggaatatatcgatggcctggagactcggatgtcagcttgcactgctcagaatcaggagttacagaggaaagtcttgcatctcgagaagcaaaacctgtccctcttggagcaactgaagaaactccaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctcccaggcccctctgcccaggggtgccttggggatgctgcactgggcagctacccacctggggatgggacgtgaggccaagaccccagcagagatgccagaatgggggaggcacagctcatagccacacacccagggcctgactgaggcccacgcaggaaccgacactcagacacaaggcaaagagggccacaggacccgggaaatacacacagagccaggagcagaagcaaagagcagacacacatacagcctgaaacagacctggacagacagacacagcctgaaacagacccggacagacagacacagcctgaaacagacccagacaaacagacagacagacacagcctgaaacagacccagacagacagacagacagcctgaaacagacccagacacagcctgaaacagatccggacagacagacagaaacagcctgaaacagacccagacagacagacagacacagcctgaaacagacccggacagacagacagacacagcctgaaacagacccggacagacagacagacacagcctgaaacagacccggacagacagacagacacagcctgaaacagacctagacagacagacacagattgaaacagacccagacaaacagacagacacagcctgaaacagacccagacacagcctgaaacagacccggacagacagacagacacagcctgaaacagacccagacagacagacagacacagcctgaaacagacccagacagacagaccgacgcagcctgaaagagacccagacagagagacaggcagacacagcctaaaacagacctggacagacaggcagacgtagtctgaaacagacctgaacagacagacagacgcacacacacaacagatgcgcagcaactccccgcccagggacccctcccggcctccctcgcacactgggaggaggaagccgccgagactgcagggagcctggccccggagccccgggtgcgccctggtctttggagcagccacggcccacaatcaccccccttttctaagactgcctgatccgaaataaagtattttgacagaa

SEQ ID NO: 113779 - DNA, 1491 bp, Homo sapiens
  Payload ID: 2229
  Gene Symbol: CREB3L3
  Gene Name: cAMP responsive element binding protein 3-like 3
  Uniprot ID: Q68CJ9
  ENST ID: ENST00000595923
  CDS Start-End: 109-1491
acagagggctgtgagcttgcccggccccaggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcaacagcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggaatatatcgatggcctggagactcggatgtcagcttgcactgctcagaatcaggagttacagaggaaagtcttgcatctcgagaagcaaaacctgtccctcttggagcaactgaagaaactccaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtga

SEQ ID NO: 113780 - DNA, 1382 bp, Homo sapiens
  Payload ID: 2229
  Gene Symbol: CREB3L3
  Gene Name: cAMP responsive element binding protein 3-like 3
  Uniprot ID: Q68CJ9
  ENST ID: ENST00000602147
  CDS Start-End: 81-1094
aggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcaacagcatcacctgggggcctcctacctcctgcgacctggggctgggcactgtcaggagctggtgctcaccgaggatgagaagaagctgctggctaaagaaggcatcaccctgcccactcagctgcccctcactaaggatgtcagcttgcactgctcagaatcaggagttacagaggaaagtcttgcatctcgagaagcaaaacctgtccctcttggagcaactgaagaaactccaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggactatgctccca

SEQ ID NO: 113781 - DNA, 1475 bp, Homo sapiens
  Payload ID: 2229
  Gene Symbol: CREB3L3
  Gene Name: cAMP responsive element binding protein 3-like 3
  Uniprot ID: Q68CJ9
  ENST ID: ENST00000602257
  CDS Start-End: 81-1460
aggtaacgctggcggtgggtgggcctccagcttggagcagagaccccccgaggcatctgcagacagaactggatggacccatgaatacggatttagctgctggaaagatggcttctgctgcctgctccatggaccccatcgacagctttgagctcctggatctcctgtttgaccggcaggacggcatcctgagacacgtggagctgggcgagggctggggtcacgtcaaggaccagcaggtcctgccaaaccccgactctgacgacttcctcagctccatcctgggctctggagactcactgcccagctccccactctggtcccccgaaggcagtgatagtggcatctccgaagacctcccctccgacccccaggacacccctccacgcagcggaccagccacctcccccgccggctgccatcctgcccagcctggcaaggggccctgcctctcctatcatcctggcaactcttgctccaccacaaccccagggccagtgatccaagtacctgaagcctctgtgaccatagacctggaaatgtggagcccaggaggaaggatctgtgctgagaagccggctgatccggtggacctgtccccacgatgcaatctcaccgtgaaagacctcctcctttcgggcagcagtggggacctgcatcacctgggggcctcctacctcctgcgacctggggctgggcactgtcaggagctggtgctcaccgaggatgagaagaagctgctggctaaagaaggcatcaccctgcccactcagctgcccctcactaagtacgaggagcgagtgctgaaaaaaatccgccggaaaatccggaacaagcagtcggcgcaagaaagcaggaagaagaagaaggaatatatcgatggcctggagactcggatgtcagcttgcactgctcagaatcaggagttacagaggaaagtcttgcatctcgagaagcaaaacctgtccctcttggagcaactgaagaaactccaggccattgtggtgcagtccaccagcaagtcagcccagacaggcacctgtgtcgcagtcctgttgctgtcctttgccctcatcatcctcccctccatcagcccttttggccccaacaaaaccgagagccctggggactttgcgcctgtacgagtgttctccagaactttgcacaacgatgctgcctcccgcgtggctgctgatgctgtgccaggctccgaggccccaggaccccgacccgaggctgacacaacccgagaagagtctccaggaagccccggggcagactggggcttccaggacaccgcgaacctgaccaattcgacggaggagctggacaacgccaccctggtcctgaggaatgcaacagaggggctgggccaggtcgccctgctggactgggtggcgcctgggccgagcactggctcaggacgtgcagggctggaggcggcgggagacgagctgtgagccccgccaggacta

SEQ ID NO: 113782 - DNA, 1750 bp, Homo sapiens
  Payload ID: 2230
  Gene Symbol: CREB3L4
  Gene Name: cAMP responsive element binding protein 3-like 4
  Uniprot ID: Q8TEY5
  ENST ID: ENST00000271889
  CDS Start-End: 269-1456
ccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaa

SEQ ID NO: 113783 - DNA, 1496 bp, Homo sapiens
  Payload ID: 2230
  Gene Symbol: CREB3L4
  Gene Name: cAMP responsive element binding protein 3-like 4
  Uniprot ID: Q8TEY5
  ENST ID: ENST00000368600
  CDS Start-End: 73-1200
aaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaatt

SEQ ID NO: 113784 - DNA, 950 bp, Homo sapiens
  Payload ID: 2230
  Gene Symbol: CREB3L4
  Gene Name: cAMP responsive element binding protein 3-like 4
  ENST ID: ENST00000368601
  CDS Start-End: 79-732
agaaagaaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggtaacatgcttcccctaagggtatcccaacccaggggcctcaccatgacctctgaggggccaatatcccaggagaagcattggggagttgggggcaggtgaaggacccaggactcacacatcctgggcctccaaggcagaggagagggtcctcaagaaggtcaggaggaaaatccgtaacaagcagtcagctcaggacagtcggcggcggaagaaggagtacattgatgggctgga

SEQ ID NO: 113785 - DNA, 1557 bp, Homo sapiens
  Payload ID: 2230
  Gene Symbol: CREB3L4
  Gene Name: cAMP responsive element binding protein 3-like 4
  Uniprot ID: Q8TEY5
  ENST ID: ENST00000368603
  CDS Start-End: 79-1266
agaaagaaaaggtgtagtgtttggggaggtcaacgggctatgctggcttgacagggctgggctcttcagaacagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctg

SEQ ID NO: 113786 - DNA, 1752 bp, Homo sapiens
  Payload ID: 2230
  Gene Symbol: CREB3L4
  Gene Name: cAMP responsive element binding protein 3-like 4
  Uniprot ID: Q8TEY5
  ENST ID: ENST00000368607
  CDS Start-End: 267-1454
cctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcagggtggcagcctgttctgcacagaaccaagaattacagaaaaaagtccaggagctggagaggcacaacatctccttggtagctcagctccgccagctgcagacgctaattgctcaaacttccaacaaagctgcccagaccagcacttgtgttttgattcttcttttttccctggctctcatcatcctgcccagcttcagtccattccagagtcgaccagaagctgggtctgaggattaccagcctcacggagtgacttccagaaatatcctgacccacaaggacgtaacagaaaatctggagacccaagtggtagagtccagactgagggagccacctggagccaaggatgcaaatggctcaacaaggacactgcttgagaagatgggagggaagccaagacccagtgggcgcatccggtccgtgctgcatgcagatgagatgtgagctggaacagaccttcctggcccacttcctgatcacaaggaatcctgggcttccttatggctttgcttcccactgggattcctacttaggtgtctgccctcaggggtccaaatcacttcaggacaccccaagagatgtcctttagtctctgcctgaggcctagtctgcatttgtttgcatatatgagagggtacctcaaatacttctgttatgtatctgtgattttatttcttctttgggtatagggttgaggggaaataagttttgagtgagaaataaacgttttagctgaaattgt

SEQ ID NO: 113787 - DNA, 982 bp, Homo sapiens
  Payload ID: 2230
  Gene Symbol: CREB3L4
  Gene Name: cAMP responsive element binding protein 3-like 4
  ENST ID: ENST00000449724
  CDS Start-End: 298-982
gactctttccgcctttgtttacaaccctgccatgatctccctcttgcaaaagcgagggctacagaacaggcattcaggagtcctgtgctccagtcacagccttttctgttcttcagctaggagacaccaaaccctcaggaagatttactatagctaagagaaaactgcagcagaaagggcgcggctacctacttcttaaattccgtttgtggaccctcagactcttagtcccctactcccagatacagcggccctaccgtggctcctggcaaggtggcatccacttttgtagtaagcatggatctcggaatccctgacctgctggacgcgtggctggagcccccagaggatatcttctcgacaggatccgtcctggagctgggactccactgcccccctccagaggttccgggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctgctgccctgtcaaaccctgttcctgaccgatgaggagaagcgtctgctggggcaggaaggggtttccctgccctctcacctgcccctcaccaaggcagaggagagggtcctcaagaaggtcaggaggaaaatccgtaacaagcagtcagctcaggacagtcggcggcggaagaaggagtacattgatgggctggagagcaggt

SEQ ID NO: 113788 - DNA, 602 bp, Homo sapiens
  Payload ID: 2230
  Gene Symbol: CREB3L4
  Gene Name: cAMP responsive element binding protein 3-like 4
  ENST ID: ENST00000431292
  CDS Start-End: 57-602
ggtaatgcttggggggggcctctttgtctaaacctgagggatagggctgaagaagcatggatctcggaatccctgacctgctggacgcgtggctggagcccccagaggatatcttctcgacaggatccgtcctggagctgggactccactgcccccctccagaggttccggtaactaggctacaggaacagggactgcaaggctggaagtccggtggggaccgtggctgtggccttcaagagagtgagcctgaagatttcttgaagcttttcattgatcccaatgaggtgtactgctcagaagcatctcctggcagtgacagtggcatctctgaggacccctgccatccagacagtccccctgcccccagggcaaccagttctcctatgctctatgaggttgtctatgaggcaggggccctggagaggatgcagggggaaactgggccaaatgtaggccttatctccatccagctagatcagtggagcccagcatttatggtgcctgattcctgcatggtcagtgagctgccctttgatgctcatgcccacatcctgcccagagcaggcaccgtagccccagtgccctgtacaaccctggtg

SEQ ID NO: 113789 - DNA, 8532 bp, Homo sapiens
  Payload ID: 2231
  Gene Symbol: CREB5
  Gene Name: cAMP responsive element binding protein 5
  Uniprot ID: Q02930
  ENST ID: ENST00000357727
  CDS Start-End: 391-1917
aacatttacaacaaagttgattctgtgtagggttggaggctagacagttccacaaatttttagtcacattttccatgtcagttaaatctagggagttcaagactactggaaaaattagtctcattactaaaagaaacttagagaacgagggaggtaccagagtctaggaggtacctctgggttgcagaagtaattgtaaaataccagacctgttctttttactaaaagctagtttcactatcttctggtctgaaatactgaggcaaatactcaagacttattttcttcctaatcttgctggtgaaacagaagttactagaaagaaaggaagaaaaaacttgatttggtgactgcaggaagcaacacgttgctgcttttattctacagataatgatttatgaggaatccaagatgaatttggagcaggagaggccgtttgtctgcagtgccccaggctgctcccagcgcttcccaacagaggaccatctgatgattcataggcacaaacatgaaatgactttgaagtttccttcaataaaaacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccaagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaaaaaaaaaaaaagcaaacctccaaaacgtggacctaaccattgcttcacttacacttcacccacagctggagttcattcaactcttgcttttcacaaaatagtaaccaggagatgtttaatgtgcctgatttaatgtttttaataatcacagcaaatgaaaggtggtttagttataagtgaagcatggttgaataccagctggggagacactagggaagggagctttgtaagccttgattgcgaaagtccaaattttgatgtggggctataacatgacacccttggattgcgactggttttatacggcctgcctataacgttgaaaatccatgtactacataataattcagaagggctctattcactacacagattacattgttcaatcatcagctgctaatagcctaagatttatttttttttttttcttaagcctatggaaccggctttgctgttctggggggtgaaaatagactaactactggagaaacaaagagagaaagaaaacccagtgtttccataggggcacttttagccttcccacaacagttaagcactctttgactgctgaaggaaccccatggatgaggtgcaggctacttcactctttttttttcttttttgagacagagtctcacctattgcccagactgaagtgcagtggtgcgatcatggatcactgcagcagcatcctccgagttcaagctatccttccacctccgcctcctgagtagctgggaccacaggttcacataaccatgcctggctaatttatttttacttttattttaaaataaaagatgaggtctgtcttatgttgcccaggctggtctcaaactatcctacttcttcctcccaaagtgttgggattataggtgtgagccactgcacccagcctacttcactcttctgaattattctgatttattttcaacaacttttgtgaacttgcccgtgatacaaagcagatagtccctgaaccacagtcgtgcctccttgaaacaagccattctactgtgctaatgttttaatatcacatctcacaaataacaggggtgaatgtttctctctagcaatctaggcaggtgctggtgtttcatctccatttgaatgcttgacctcttaatgtgtgtgtgtgtgtgtgtgtgtgtgtgtgtgttcatgggttttaaaagaacagtattttacaaaaggtgtagcttttataagagtgcagaaaagggaaggatgtgtttttttctctcactatagtataagaatctattttggagaaaaaaagaaaatatgagggtctcgaagcatgatttttatataactagtttcagttttatctaataacttactttttaaatcaatatttatcaacaatctttccttgtatgcagtgctttcaaaagatggttttgagtgtccagtgaaacttatgacttggatatatggttgaagaatcaaaacaaaagcaaaaaaaaaaagcaaaaaaagaaaagagaaaaaaagaaaaaatgcaaatggaataattttctattatattttagacaaacatatcattttcgagtattttaaatactgaattcatagttgttgttttttaaattccaacagtaacagctgaatggtttaatctgactggcttcctaagaaatgtttaagactcagctttaaaaagaagttaacattcatatctctgttttgaaatcaaaaatcatatttcaaaattctttcctaggaccatctatgtgtctcccctcccctccacaaaaaggagaaagagtgcattaaaatgtttagttgggttttttaatttttaatttttatgttatgttttgctttgttttaagtaaacaaaaatttttctttctttactgcatgcatagcacttaataaaatggatttttaaaaaatccactagtaatatcagaatgtccagggagtgactgtcactacaatgatggtttagtttacttctgttccaccttttgattgaaatatttagttgttaggctgaaagcctcggcagttaagaacttgcctgagttttcttcgttcagcaacttgacagtttgactgatgtgcattatatatagctcaattatgtctgttttttatgctaagtaggaaaaccaaccacacacattagcaaaccggcctcaacatataattagaataaactgtcttcttgttctactcagggcctttaggtgtgttcattcacggtatggaaatacagtaaatgaaagattccaactagttgtcagtgcttcttgaaattccaaacagaaagatacattggtcaaatccaacacttggcttatcaatattaagtcttttacctaaaggcccagccgtcaccagacaacagaataatcaatctgcctgaaaatccctcctccttgtcctacactttttgcctgtttgggagaatatctttgtactccattctcctccctcagccagttactgggtcacccatccatgtgttcatgaatcaatcatcacggcctgcagagcacctgtcctaaggagggaaaatcctgtcacactgcctctccccattcgtgtgtggttttcttgatcggtgagatctgtctctgaagtcactgccagcctccctgggaacgtctatagtgcctcccctgccttatgtgatgggagttaacaactcagataagtacacctgagagcatttctatcaggtaaactgtcacttaaatggaggtgtccacatcttaattgtttctccttgacacatttctcaatccacgaagccaggagaggtagagtgaaaatcccagccatggatgaatgtactaatttgaaagccaagtgttaagtcggatgttttcccgttacactactactcagccctctcctgcggccacatcaacggatgcaagtcacagtcttaacacagcctgtgggagacaagcagtttgtgtgctcacagtatatattatagtaattagggtgacttagagcaaatactcttcagatcctatgtagtcagtgaaacaaaatggagagcgtattctgatagaaggacgtcgacggtgaatgttctggtggttgttgcctgttaagtaaactttagtgtgtaagttgagtttgtcattaaaatcataaaccagctgcggtaacagacaagcctttggctggggagttttaagcctcggtaactgctataaaactagccatccagttaggatagaatgtgtttctttctggttaaaaaaaggaaaaaccatctaagaaaatatatatgtatgtatgtgtgtatacagtggaattcaaaggaccaaagcaaaatttgaacaggaatctattaatttagaattttataagatatttattaataaatgttatttttaaacattccatttgaacagtattctgtaggatctacttgtttttaaagtgttagtccataataaactactatagttatgtgtattttcatttttcagggtttcaaatggctattctccatcatttggtggaaatgtttgcttagatctctgtgcatagacatttcaaggatttttattgctctgtgagttattttttaatcaacattctgaacagttttttttaaacatttatttctgtgtgttcatttttaaagtaagctctttcatttaggaagcagagttcagctaaagggaatcagtaactctaactggaacagctttcttgtagaagtgtaaaaacagcttcatctctgcctctctccaccccaccccaatttcctagaaagccttgcactattcagctcccttagtgctttttgtcccttcccgaacaatatgcagtagctttaagccattcaagctccattatgcagtatatctgagaagggaaaggaaacaacccatttaaatttgaataaaaccgtgcctatgcgaacagtagcaatttagaatctcttttctgcttttaaaataatttatatttaaaaattgcactttagctttttgatccctttgtatttctcttattctctttctaacctcttctctgtcctcaaacttgcctttgctctcctttacaataccccccacccctcctccaaggctctgagcggcatcatttaaaatactttacagatatttgcaccaggtacatttatgtgcgtccattggtagcacagctgagacctgtgtctcacatcagcctaggtgaagcctactacaagaatgccaaggagaagagccagtacactatatggtttatactctttatccctttattcatagcatgttttttaaaaatgttatattatgcaacagatgtgaggcagcagctaagctatacttaagaattttctctcaccttccaaaccaaagtgtcctgaataagccaggagacttattcttttgtgcaccctggtgcacatctgactgttgtcctagccatagactctctgaggccactgaaagaacagtggccctatcgatttcattcctaggtctcaaaaatacaatgttgccttgtaacataattagggacagcacctctatttcacaattataatctaaggtaggataagacgacacagcagcaataaacttacaagtaaaattcaataccaaaacaaacacaaagaaatttaaaaaacaaaaaacctagctcatcatgttgtgaaaatgaaaaagtgaatgtccattcaaaatattttactatttcttgtggagtttttcagtgatgtaatgcttgtagccaaattgcttaaagagtgtttatatatttttttccttataaattgtctattttttaaaaaagctatttaaccacagctgaagtggggggtaaggccaaattgccaacacttgttaaaagattaatactcttaagtggcactctgatacctttccaacttgtcatcagaaaggaatcaataattaccaactgttgtatttagaccaacttacaatatctagctcattagaagccaggatctagaaagctccttctaagccatttaagatattcttacattgagcttcatattatagaactttataggattggatattttacaatagaataatttagcctcaggactgagaatgtggaagctgaataaattagctttaaatacatcattaaaatcttatgcacaataagctcattagattctagttttctcctttagaataccaatgccacagacactacaggagataatgaaaggtatcagttgtgttgagtggagggagtttaagagaaaggacccttcccaaccagcagccagtagaaaatacaacctactcacctttttcccttctaagttctgctaaatcacatctgcctcatagagaaaggaatgttgcctttgagaactgtcttggagaacagataagcttgaaatgttctctctagagaggacatagggtttgggatcctctgaaaaggcccagaaaaatagctcagttcaaatacaatgttctaggacaattggaatataaatattgtccaaaaatataattaaaagaaaaaagtttagcactgtgtaaagtaagtgttaactgaggaagtcccaaaaaggtgctgtcactttaagttctggacttggggttctttgtatttgtaaacagcaaagcatttgtgtttgtttgtctatttgtaaagcaaccaccttccttattggaaggagaaaaaaaggggtacatacatgtaaatacttgctgcagcatttaatatgtttaattttgtgttaagctttttgttgcatcgtgaacacatttattgttaccaatggacaatgagttcattaagactgttcaactaggtcagatttttacatctctttctagcaagaagagacaagattttgtgcatttgtacaaatgttaatatcactgcaattccaatataataaagcactcaaatgcaaataa

SEQ ID NO: 113790 - DNA, 2001 bp, Homo sapiens
  Payload ID: 2231
  Gene Symbol: CREB5
  Gene Name: cAMP responsive element binding protein 5
  Uniprot ID: Q02930
  ENST ID: ENST00000396298
  CDS Start-End: 171-1280
agagagcaagtgagcgagagcccagccggagggagagccagagctaggcgcaaaagaagggccagcacattacatcatcgcttggcctggaatcaaatgggaaggatatgactcactcaagctagttaagctttggctcaaattctacacacactcattccagagctctcatgttctgcacctcaggagggaattcagcctcagtgatgtccatgaggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccaagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaa

SEQ ID NO: 113791 - DNA, 2294 bp, Homo sapiens
  Payload ID: 2231
  Gene Symbol: CREB5
  Gene Name: cAMP responsive element binding protein 5
  Uniprot ID: Q02930
  ENST ID: ENST00000396299
  CDS Start-End: 146-1573
gatctgatgaatccaaggagtggagcaagaggcagattttggacacggttatgagaatgacagaaactgcctaaagcatttatgctctggcattcgtccctgtttctggaggtccagtaagcgcttcccaacagaggaccatctgatgattcataggcacaaacatgaaatgactttgaagtttccttcaataaaaacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccaagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaa

SEQ ID NO: 113792 - DNA, 2319 bp, Homo sapiens
  Payload ID: 2231
  Gene Symbol: CREB5
  Gene Name: cAMP responsive element binding protein 5
  Uniprot ID: Q02930
  ENST ID: ENST00000396300
  CDS Start-End: 93-1598
ttttagtggtggagtcaatttatttctgaaacgatctcatttacctgaatgaggagctcatatttattttcaggatttatgaggaatccaagatgaatttggagcaggagaggccgtttgtctgcagtgccccaggctgctcccagcgcttcccaacagaggaccatctgatgattcataggcacaaacatgaaatgactttgaagtttccttcaataaaaacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagctaaaatgaggtatacctagatgtcaagtaagacagatccaaggtaactgggtaggaaatcttttgacatcttaactcatgttgagtttgtgctgtggtgtcaccagaattccagataaacacacagcctttcccatacctttttttttcttactataaaatattataagatccattgatgtccaaataataccaccaagcatctcttcacctctcctcctcttggtccacttgctaatgcccagttttcttctccatttccactttttcttaggctccctatttactattcattttgacttccttctgttttatttttttccctttagcattgcatgtgaataagaaaataatgtttaaagaaa

SEQ ID NO: 113793 - DNA, 1944 bp, Homo sapiens
  Payload ID: 2231
  Gene Symbol: CREB5
  Gene Name: cAMP responsive element binding protein 5
  Uniprot ID: Q02930
  ENST ID: ENST00000409603
  CDS Start-End: 159-1586
ctttcaagagcactaggcagtgacgggaagcggagtgatataacggtagcctgagaaggaaacagtttttttaaaaattaaaggatagccgagctggagtttgtcaagaacaagaaaccagtgagacagaagggcgcttcccaacagaggaccatctgatgattcataggcacaaacatgaaatgactttgaagtttccttcaataaaaacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctgcccaaccatgacaccaacgttgtgattcagcaagccatgccgtcgcctcagtccagctctgtcatcactcaggcaccttccaccaaccgccagatcgggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccgggcagctgccacccgctgcagacagaagaggaaggtctgggtgatgtcattggaaaagaaagcagaagaactcacccagacaaacatgcagcttcagaatgaagtgtctatgttgaaaaatgaggtggcccagctgaaacagttgttgttaacacataaagactgcccaataacagccatgcagaaagaatcacaaggatatctaagtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgtatatagccatggtttcattcttatcagtccaaccctttgcctgaaacattgaatcttgttaaaccacagcttttagct

SEQ ID NO: 113794 - DNA, 563 bp, Homo sapiens
  Payload ID: 2231
  Gene Symbol: CREB5
  Gene Name: cAMP responsive element binding protein 5
  ENST ID: ENST00000424599
  CDS Start-End: 219-563
acccgggctccgctcttgccttctccacacttgtttgagacctggcaaggtgcggagccctccagaagtgcggtcaagcggcagcggagacggcgagccaggaacctccccccgcgtccccagcttcccagcgtggcggcggaacccccggagaaagaataaagactggatacaggtccattacgtcattctgcaggccaatttatgaggaatccaagatgaatttggagcaggagaggccgtttgtctgcagtgccccaggctgctcccagcgcttcccaacagaggaccatctgatgattcataggcacaaacatgaaatgactttgaagtttccttcaataaaaacagacaatatgttatcagatcaaactccgaccccaacgagattcctgaagaactgcgaggaggtgggcctcttcagcgagctggactgctccctggagcacgagttcaggaaggctcaggaagaggagagcagcaagcggaatatctcgatgcataatgcagttggtggggccatgacggggcccggaactcaccagcttagcagcgctcggctg

SEQ ID NO: 113795 - DNA, 753 bp, Homo sapiens
  Payload ID: 2231
  Gene Symbol: CREB5
  Gene Name: cAMP responsive element binding protein 5
  ENST ID: ENST00000426500
  CDS Start-End: 119-753
gacagaagtacagctttaaatagccttgcagatacatttttctaaaaatgcagacctgaggcctgtcccaggctctctatcttctctgctacatctccacaacagacagagacagcccatgccagcctccatgcctgggaccctgcccaaccctacaatgccaggatcttccgccgtcttgatgccaatggagcgacaaatgtcagtgaactccagcatcatggggatgcaaggtccaaatctcagcaacccctgtgcttctccccaggtccagccaatgcattcagaagccaaaatgaggttgaaggctgcattgactcaccaccctgctgccatgtcaaatgggaacatgaacaccatgggacacatgatggagatgatgggctcccggcaggaccagacgccacaccatcacatgcactcgcacccgcatcagcaccagacactgccaccccatcacccttacccacaccagcaccagcacccagcacaccatcctcaccctcaaccccatcaccagcagaaccatccacatcaccactcccattcccaccttcatgcacacccagcacatcaccagacctcgccacatccgcccctgcacaccggcaaccaagcacaggtttcaccagcaacacaacagatgcagccaacccagacaatacagccaccccagcccacaggggggcgccggcgaagggtggtagacgaggatccggacgagaggcggcggaaatttctggaacggaaccg

SEQ ID NO: 113796 - DNA, 588 bp, Homo sapiens
  Payload ID: 2231
  Gene Symbol: CREB5
  Gene Name: cAMP responsive element binding protein 5
  ENST ID: ENST00000498316
  CDS Start-End: 1-120
cttcagaatgaagtgtctatgttgaaaaatgaggtggcccagctgaaacagttgttgttaacacataaagactgcccaataacagccatgcagaaagaatcacaaggatatctaaattgagcaacacagattctcccaccacatgtccagagagtagccctcctgctagtcctgtcccagcttgctcccagcaacaagtcatccagcataataccatcactacttcctcatcggtcagcgaggtggtaggaagctccaccctcagccagctcaccactcacagaacagacctgaatccgattctttaaaatgcaccatcagacctggcctccaagaagagctgtagcgtaccatgcgtcctttcttttaagggcatttttagaattaactcagacctggaagactcctcagttcttcaaagactggctttcatttttatagttattatggaaatgttgtcttttatacttagttatataagaaaaaagggagttatgcaattaatatctatcagcttgggaaacgctttggtgcttttctccagttttctggtaccagttacttgtttataaactgaaccttttctgt

SEQ ID NO: 113797 - DNA, 3754 bp, Homo sapiens
  Payload ID: 2232
  Gene Symbol: CREBL2
  Gene Name: cAMP responsive element binding protein-like 2
  Uniprot ID: O60519
  ENST ID: ENST00000228865
  CDS Start-End: 282-644
cagagcgtctgtaaacacccagagactgtcatggagggggaggaggaggcggcggcggcgaagggaggcgtttggggccgcctccagggtccgctctgccattcctgaactggtccctcgtccccgtgactctggcatcagggaagcgaactgttaggcgagaggaggaggcagccagaaccatatccccttcttcctcggggcgggggccgggccaggccggctgagccgggggagggctccgggagggagtgcctggccaggccggcctgtctgccgcgatggatgacagtaaggtggttggaggcaaagtaaagaagcccggtaaacgtggtcggaagccagccaaaattgacttgaaagcaaaacttgagaggagccggcagagtgcaagagaatgccgagcccgaaaaaagctgagatatcagtatttggaagagttggtatccagtcgagaaagagctatatgtgccctcagagaggaactggaaatgtacaagcagtggtgcatggcaatggaccaaggaaaaatcccttctgaaataaaggccctactcactggagaagagcagaacaaatctcagcagaactcaagcaggcataccaaggctgggaagacagatgctaatagcaattcctggtgaagattatataaagatgagtcagtgattgaagccaatattctgattcccatggaagatggatgggcaagagtgtacttcttggctccatttactacctactgctcagtagtcatctctgtaaatctgcaatttctaccaaaatgtgtgatcgtagatctcaaaggatcttgctttaactttcaacacttagaaaatctacaaacattcagacctgtctgggttggtattgccacccatgacatttaacatgttgtgatgcttgaaaacacaggagtagagaaaatcgatgaagattgtatttttgcaccttaactccacattgctttattggttaatttatattctttccatgtaattcatgtaattgtatgtctgtgtgtgttttatgtgtcaccacctttcatgtttttgattgccctacaaagagaaaccaaatgagctgattactgactataagttctcagcctttatggacctaatcttatttttatttacttgagtaatgtttattctctgcatgaaccatgatttctcctgtgagccattccagcataagctgtgaatatgtattaacaaatatatacatttctatttttataatccataaggatatgcctgttttaaataacatacatattaacaatatctatcaggaaaaccctcaagacagcttctagttaaaacctttgttgctgtcctctcaaactatatttataaaaatttgctagggccaaatccatacttgcagaataattcatcaaattttatttttaagtgaaaagtaacctttcaggcatttcagcagcatacattgacaatctagggtatatatgtatgtatgtttcttattgtatgtctatatatgtatgtggggaggacaggagtgaatgttcacacacttttcttgcgtactcaactaaattggagaatgtttctgaagaaaattggatgaaattagctgctgagattgagtttctgccttaaaatctgaaacaaaaaaagggacaaattgctggtagatctactgactgtagccatcaccagaacacttagtttcttcccagacatgaatttcctgacaggctctgagccagaaacacactgtgggcgtgcatctggttcagccctggatatgcctccactgtggagggaagcattggaactggagttgtgcacagcaccgcagctagtgggcctggctgggggtgcagaagggcagggtagttctttccatttccccttgcagctacacttactttctccctgactaccaaatggagtgacggttgaagaatcaagctcataatatgatacacccagacagacccagaaatcttttgatttccccagcgagatacttaccactctctcttctctttcccatggttaaaacaggagttgtgttctctgtcgctgctaaattattcttcacttgagtgaagcaaatatttagcttccaaataaagtatattttgttctgaactggcagtttaagaggagataccgtagtctagattgtctttgaggtagaatatatgatggaccacatagtttaagattacaaggtactttccctcttctctcaggccatgcatttgaataaagtgcctcccttagcctgagctcctaaagacctcttgtacttggttgcaaactcagatctctagtctagtctagtctagtctagtctagtcatgtgtgactgtgtactgagataccactagcccagtttgctgggtctctatgttttggaagttgggggtttaataatatttaatgtctttttaggatcataaacataaataggtttgttgatattcaggccttcagaatttaagggttttaaatatagcattcagattgtaattggtatgtttttgccatctggtccactcaattgtatatttttattttgcaaaacaacccaaaacttactttatgttgctttgttcagtaccttttgaattcccccagaagagttgttttcaaaacaaacattccagaatgaatgtcgctcttcaatggaacgtctttattgtgcttgaagtatttcttctctggttgtaattctaaattacagagtcatttgagctttctcccctcccgctagtatctttacaggagcagggaagagcagtagaggatgtataattttgggcgaagttaaattacaatttatttgaggttattcctaaacctatttatttggtgttttggaggagatcacacactaagagaacgttgattgcctcggctattgtgctggctggacactttggtcacttttgaagcatgttaataaatgtcactgattaaaacagctggagcatttccttccctttccagtgaaggagcagcatagtgaaatcctggcacccctcacctttttgtgatgacaagatggctgacagtcacggagtccaggagaaggtgctgctctccttgctttctgagtaaacagagtaatgttttttttcttattttcccaaagaaagaaaagggggaaaatatatttgtatgtttagaccagccaaattctgtcattattttagtatcaacctgctgtatattagagcaactgaatataatatggaataagtttgaccaggtcaagttttaggatatagttgaatttctttaaaaagttttctattttatctaaaatctttccattatatctaaattagaatgatcatcctgcgcaaattcagattactgtttgctggctaattgacagtatttctcagcatcactatgtagcattctgttttagcatctttgaattatgatcatttgatttggctaattacaaaaagtacaggtttaaactggacttagcttgagttaaaggcaaagaaaatctaaaaacataaatgttatatttcacaagaaatcagttgcatattatccattacatatttagttttaaaaggaggagtcaccttgaattattttctgagtcaccttgagttatttgatctctcagcctgctttctcatctgtaaaaaaggggggaggataactttcacagggtaattggtaggctaaataggagttacagaaaactgttaaatagggaagaactacattaaatttaaatattcacatta

SEQ ID NO: 113798 - DNA, 2220 bp, Homo sapiens
  Payload ID: 2233
  Gene Symbol: CREM
  Gene Name: cAMP responsive element modulator
  Uniprot ID: Q03060
  ENST ID: ENST00000345491
  CDS Start-End: 163-1065
gacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 113799 - DNA, 900 bp, Homo sapiens
  Payload ID: 2233
  Gene Symbol: CREM
  Gene Name: cAMP responsive element modulator
  Uniprot ID: Q03060
  ENST ID: ENST00000337656
  CDS Start-End: 1-900
atgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaa

SEQ ID NO: 113800 - DNA, 1541 bp, Homo sapiens
  Payload ID: 2233
  Gene Symbol: CREM
  Gene Name: cAMP responsive element modulator
  Uniprot ID: Q03060
  ENST ID: ENST00000342105
  CDS Start-End: 111-848
ggaacattcttagccaccgaagtatgggcaccaaaagcgataaggagcatgtgttccttaataaatgtcacatcagaaaatgactgttccaggacagtaaccacctcccgatggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatg

SEQ ID NO: 113801 - DNA, 1625 bp, Homo sapiens
  Payload ID: 2233
  Gene Symbol: CREM
  Gene Name: cAMP responsive element modulator
  ENST ID: ENST00000344351
  CDS Start-End: 241-528
cagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaat

SEQ ID NO: 113802 - DNA, 1821 bp, Homo sapiens
  Payload ID: 2233
  Gene Symbol: CREM
  Gene Name: cAMP responsive element modulator
  Uniprot ID: Q03060
  ENST ID: ENST00000348787
  CDS Start-End: 1-666
atgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccaca

SEQ ID NO: 113803 - DNA, 1589 bp, Homo sapiens
  Payload ID: 2233
  Gene Symbol: CREM
  Gene Name: cAMP responsive element modulator
  Uniprot ID: Q03060
  ENST ID: ENST00000354759
  CDS Start-End: 87-833
cgaggtccgctacgtaaatccctttgcggcgggataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataa

SEQ ID NO: 113804 - DNA, 1895 bp, Homo sapiens
  Payload ID: 2233
  Gene Symbol: CREM
  Gene Name: cAMP responsive element modulator
  Uniprot ID: Q03060
  ENST ID: ENST00000356917
  CDS Start-End: 44-370
tgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaa

SEQ ID NO: 113805 - DNA, 2170 bp, Homo sapiens
  Payload ID: 2233
  Gene Symbol: CREM
  Gene Name: cAMP responsive element modulator
  Uniprot ID: Q03060
  ENST ID: ENST00000361599
  CDS Start-End: 211-1023
taaaccccatcgtgagggaacctagctacgggtcagagctagtccactaggtgctaatcaaatgctgtgttacaacactgtgaggttttcccagttataagtgtcactattagggttttttttaattgcaaagccaaataaggctgtcaattgcatcatcttaccttatttcttcagattaagtactgtttatagtgggatttttggtggatgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccc

SEQ ID NO: 113806 - DNA, 2020 bp, Homo sapiens
  Payload ID: 2233
  Gene Symbol: CREM
  Gene Name: cAMP responsive element modulator
  ENST ID: ENST00000374721
  CDS Start-End: 487-1296
ccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcgggataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtcttt

SEQ ID NO: 113807 - DNA, 1207 bp, Homo sapiens
  Payload ID: 2233
  Gene Symbol: CREM
  Gene Name: cAMP responsive element modulator
  Uniprot ID: Q03060
  ENST ID: ENST00000374726
  CDS Start-End: 276-689
gcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaagaaaattttggggtaaaaaggagaatttttcctatttacatgtttatattaatctctagtaaaacattgtttttgttgtctttatgatgcatgcgaacataaatgtctgtatttcattcttgttggcttttgttacccacaattacatactattcttactaatctgagagttttctaaagtatgttttcaatgtttcactactctctactctgttaatttgtgctacagtttttcctaaaagagaatggaaaaatgatttaattttttaaactgtagcaattggatagataattttatttgaaattttacacactgaaagctctaaataaacagatacattcacattca

SEQ ID NO: 113808 - DNA, 1933 bp, Homo sapiens
  Payload ID: 2233
  Gene Symbol: CREM
  Gene Name: cAMP responsive element modulator
  Uniprot ID: Q03060
  ENST ID: ENST00000374728
  CDS Start-End: 116-781
cgggacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcacc

SEQ ID NO: 113809 - DNA, 711 bp, Homo sapiens
  Payload ID: 2233
  Gene Symbol: CREM
  Gene Name: cAMP responsive element modulator
  Uniprot ID: Q03060
  ENST ID: ENST00000374734
  CDS Start-End: 1-711
atgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaa

SEQ ID NO: 113810 - DNA, 849 bp, Homo sapiens
  Payload ID: 2233
  Gene Symbol: CREM
  Gene Name: cAMP responsive element modulator
  Uniprot ID: Q03060
  ENST ID: ENST00000395887
  CDS Start-End: 1-849
atgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 113811 - DNA, 1476 bp, Homo sapiens
  Payload ID: 2233
  Gene Symbol: CREM
  Gene Name: cAMP responsive element modulator
  ENST ID: ENST00000429130
  CDS Start-End: 206-1243
tgggcggcggcgccgctgctgagcggcggtcgggctcgccgtctccacctcctcgcgtccgtaatcagtgacgaggtccgctacgtaaatccctttgcggcgggataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtttctgtggctggatcaggcaccagaagaggctccccagctgtaactctagtgcagttaccttcgggccaaactatacatgtccagggagtaattcagacaccacagccatgggttattcagtcatcagaaatacacaccgttcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaa

SEQ ID NO: 113812 - DNA, 635 bp, Homo sapiens
  Payload ID: 2233
  Gene Symbol: CREM
  Gene Name: cAMP responsive element modulator
  ENST ID: ENST00000427847
  CDS Start-End: 166-635
cgggacccgcctgcctcctcgcgaacttgggacgagttggaaaatcctccctgagagagccgtgcggctcaggggagcggtttaactcggaaaaggaaaaggaatccagaagataaataaagaaaacaggaaaggaggaaagcattgattacaaatatcttaacaatgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcaggg

SEQ ID NO: 113813 - DNA, 2306 bp, Homo sapiens
  Payload ID: 2233
  Gene Symbol: CREM
  Gene Name: cAMP responsive element modulator
  Uniprot ID: Q03060
  ENST ID: ENST00000439705
  CDS Start-End: 1-747
atgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaagttcttagtgttggtttaatattacctaatgaaagtgatgacatattttttatatctggaatgagcctgttgggatcgcattgcataccttcggggtacaagtcagtttctacactgggtgctgatccttgcacgcgccctttctaccatctcacggtggggatggccgcagggctgtgcacccagaagaagatggctgttagcgtttcggccttcataatggcctgagactttctttctgtaggtggtctggagctgtccggctggtggccccctattttgccatttagcgaacaaccacaggaattttaaaaacaaaaacatcccaagattttttcatttcaaaatgcttcaaagtccacattagatcagatactccgctgtcggcacattcagctgaggttcattacaatcgagactgcaatgtgatctatgtttcatcttgtttttataataaaaagcttcagggaacaagcccaaagccctcaccac

SEQ ID NO: 113814 - DNA, 1074 bp, Homo sapiens
  Payload ID: 2233
  Gene Symbol: CREM
  Gene Name: cAMP responsive element modulator
  ENST ID: ENST00000490460
  CDS Start-End: 240-428
gaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatattt

SEQ ID NO: 113815 - DNA, 555 bp, Homo sapiens
  Payload ID: 2233
  Gene Symbol: CREM
  Gene Name: cAMP responsive element modulator
  ENST ID: ENST00000495301
  CDS Start-End: 321-555
attcttagccaccgaagtatgggcaccaaaagcgataaggagcatgtgttccttaataaatgtcacatcagaaaatgactgttccaggacagtaaccacctcccgatgaaaatcttgtattataggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaag

SEQ ID NO: 113816 - DNA, 660 bp, Homo sapiens
  Payload ID: 2233
  Gene Symbol: CREM
  Gene Name: cAMP responsive element modulator
  ENST ID: ENST00000484283
  CDS Start-End: 1-660
atgtggtggcatcagcataatctatgtttcaggcgtcctatagaagaggattattcttcaggggatgtggaagaaaaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 113817 - DNA, 469 bp, Homo sapiens
  Payload ID: 2233
  Gene Symbol: CREM
  Gene Name: cAMP responsive element modulator
  Uniprot ID: Q03060
  ENST ID: ENST00000490511
  CDS Start-End: 55-396
cttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaa

SEQ ID NO: 113818 - DNA, 563 bp, Homo sapiens
  Payload ID: 2233
  Gene Symbol: CREM
  Gene Name: cAMP responsive element modulator
  ENST ID: ENST00000494479
  CDS Start-End: 217-563
gtgcttggaacattcttagccaccgaagtatgggcaccaaaagcgataaggagcatgtgttccttaataaatgtcacatcagaaaatgactgttccaggacagtaaccacctcccgatggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggc

SEQ ID NO: 113819 - DNA, 1049 bp, Homo sapiens
  Payload ID: 2233
  Gene Symbol: CREM
  Gene Name: cAMP responsive element modulator
  Uniprot ID: Q03060
  ENST ID: ENST00000488328
  CDS Start-End: 58-387
actttatgttgaactgtggtagaggaaacaagacagttctgtctgcagaagcccattatggctgtaactggagatgacacagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaactctactgtgtaatataaaagatcttgcagaa

SEQ ID NO: 113820 - DNA, 626 bp, Homo sapiens
  Payload ID: 2233
  Gene Symbol: CREM
  Gene Name: cAMP responsive element modulator
  Uniprot ID: Q03060
  ENST ID: ENST00000474931
  CDS Start-End: 162-500
gtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttg

SEQ ID NO: 113821 - DNA, 429 bp, Homo sapiens
  Payload ID: 2233
  Gene Symbol: CREM
  Gene Name: cAMP responsive element modulator
  Uniprot ID: Q03060
  ENST ID: ENST00000487763
  CDS Start-End: 64-429
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 113822 - DNA, 964 bp, Homo sapiens
  Payload ID: 2233
  Gene Symbol: CREM
  Gene Name: cAMP responsive element modulator
  Uniprot ID: Q03060
  ENST ID: ENST00000463314
  CDS Start-End: 191-607
ggaacattcttagccaccgaagtatgggcaccaaaagcgataaggagcatgtgttccttaataaatgtcacatcagaaaatgactgttccaggacagtaaccacctcccgatgttgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatc

SEQ ID NO: 113823 - DNA, 453 bp, Homo sapiens
  Payload ID: 2233
  Gene Symbol: CREM
  Gene Name: cAMP responsive element modulator
  ENST ID: ENST00000464475
  CDS Start-End: 1-160
tgatggaagtataacagcttctttgacagagagcaagtctgctcatgtgcagactcagactggccaaaattcaatccctgctttagctcagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaat

SEQ ID NO: 113824 - DNA, 655 bp, Homo sapiens
  Payload ID: 2233
  Gene Symbol: CREM
  Gene Name: cAMP responsive element modulator
  ENST ID: ENST00000487132
  CDS Start-End: 96-655
gcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacactgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgt

SEQ ID NO: 113825 - DNA, 1030 bp, Homo sapiens
  Payload ID: 2233
  Gene Symbol: CREM
  Gene Name: cAMP responsive element modulator
  ENST ID: ENST00000474362
  CDS Start-End: 418-708
ctaggccccgccccctgacccgcaccttcccgccgcccctccccggttccatttcattgttggattgtggcgcttcactcctgctggcggccggcagggggcggagttcgagcctggatttttttcctcggggcctcccccgggaggccgtcccggcgtgggggaggggaggacggggcgggaggacgcggttcggtcggctgcagcgctacttttggtccggggtcggcagggaggccgcggctaccgcatcacagctgacgtgaggactacgtggggccgctgccggctccgggttgctgggcggcggcgccgctgctgagcggcggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaa

SEQ ID NO: 113826 - DNA, 651 bp, Homo sapiens
  Payload ID: 2233
  Gene Symbol: CREM
  Gene Name: cAMP responsive element modulator
  Uniprot ID: Q03060
  ENST ID: ENST00000488741
  CDS Start-End: 308-616
gagtcatgttgtgatttagtcagttcctttccgctttgtaaaatgctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtggtaagatcgagcctcctactgaggccgtccctgcatgcgcctgatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaa

SEQ ID NO: 113827 - DNA, 582 bp, Homo sapiens
  Payload ID: 2233
  Gene Symbol: CREM
  Gene Name: cAMP responsive element modulator
  ENST ID: ENST00000463960
  CDS Start-End: 1-582
gtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacaatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 113828 - DNA, 582 bp, Homo sapiens
  Payload ID: 2233
  Gene Symbol: CREM
  Gene Name: cAMP responsive element modulator
  Uniprot ID: Q03060
  ENST ID: ENST00000468236
  CDS Start-End: 155-532
gctgctgacagatttagagttaactagctcaccactgcctctgcctccaagctgccttttagactgaatagcttttcttgttagccctactttaacatttcttttgaagtggttgtctgcttgaagagggaaacacgtcatgaaactgtaatgcatgaacagaactcaggagttgtctggccagcttagtgatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaagga

SEQ ID NO: 113829 - DNA, 731 bp, Homo sapiens
  Payload ID: 2233
  Gene Symbol: CREM
  Gene Name: cAMP responsive element modulator
  Uniprot ID: Q03060
  ENST ID: ENST00000489321
  CDS Start-End: 149-562
cgccccacgcccgcttcgtgcgctcagctgccccgggacccgcctgcctcctcgcgaacttgggacgagttggaaaatcctccctgagagagccgtgcggctcaggggagcggtttaactcggaaaaggaaaaggaatccagaaacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacagtatgtatgctgcaattcgatatgatacagtgctagctttaagtcttctctagttatattgaagcaactcaggttttggcattaaattgttccattttaaaatgcatcattaatacctaaactgtatcatagaatgaaagtatatgttaaaaagtgagatctttgtattgacagctgtcatataattttgaaaagtaaaaattttgactgccgaatatagaa

SEQ ID NO: 113830 - DNA, 1416 bp, Homo sapiens
  Payload ID: 2233
  Gene Symbol: CREM
  Gene Name: cAMP responsive element modulator
  ENST ID: ENST00000460270
  CDS Start-End: 92-379
cggtcgggctcgccgtctccacctcctcgcgtccgtaatcagtgacgaggtccgctacgtaaatccctttgcggcggctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataatgcatccagcagtacaataaaagtaaaccacaaaaaaatacctcaggaaagaatagaaagaaagtctatctaatgacatgcctatatgagaagaatagcctagatatgaatatatggcatttgcagatttttatattagttgctttgttaaaaaaaaaaagattgtattgctgtccttgaatgccatagtcaaagagagtttttaatagaaccatgttggttgcactttgtagtgtttggtgctcatttaaatatctgaacatttactacagtttttaact

SEQ ID NO: 113831 - DNA, 895 bp, Homo sapiens
  Payload ID: 2233
  Gene Symbol: CREM
  Gene Name: cAMP responsive element modulator
  ENST ID: ENST00000495960
  CDS Start-End: 136-276
cgtggggccgctgccggctccgggttgctgggcggcggcgccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcagaaaatcttgtattataggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaaga

SEQ ID NO: 113832 - DNA, 939 bp, Homo sapiens
  Payload ID: 2233
  Gene Symbol: CREM
  Gene Name: cAMP responsive element modulator
  Uniprot ID: Q03060
  ENST ID: ENST00000479070
  CDS Start-End: 1-939
atgagcaaatgtgcaaggaaaaaatatattaagacaaatccaagacaaatgaccatggaaacagttgaatcccagcatgatggaagtataacagcttctttgacagagagcaagtctgctcatgtgcagactcagactggccaaaattcaatccctgctttagctcaggtagcagcaattgcagagacagatgaatctgcagaatcagaaggtgtaattgattctcataaacgtagagaaatcctttcacgaagaccctcttataggaaaatactgaatgaactgtcctctgatgtgcctggtgttcccaagattgaagaagagagatcagaggaagaaggaacaccacctagtattgctaccatggcagtaccaactagcatatatcagactagcacggggcaatacattgctatagcccaaggtggaacaatccagatttctaacccaggatctgatggtgttcagggactgcaggcattaacaatgacaaattcaggagctcctccaccaggtgctacaattgtacagtacgcagcacaatcagctgatggcacacagcagttctttgtcccaggcagccaggttgttgttcaagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactag

SEQ ID NO: 113833 - DNA, 1182 bp, Homo sapiens
  Payload ID: 2233
  Gene Symbol: CREM
  Gene Name: cAMP responsive element modulator
  Uniprot ID: Q03060
  ENST ID: ENST00000473940
  CDS Start-End: 64-426
tggaacactttatgttgaactgtggtagaggaaacaagacagttctgtctgcagaagcccattatggctgtaactggagatgacacagatgaggaaactgaacttgccccaagtcacatggctgctgccactggtgacatgccaacttaccagatccgagctcctactgctgctttgccacagggagtggtgatggctgcatcgcccggaagtttgcacagtccccagcagctggcagaagaagcaacacgcaaacgagagctgaggctaatgaaaaacagggaagctgcccgggagtgtcgcaggaagaagaaagaatatgtcaaatgtcttgaaaatcgtgtggctgtgcttgaaaaccaaaacaagactctcattgaggaactcaaggccctcaaagatctttattgccataaagtagagtaactgtctttgacttggaccttgtttactctaatcaaggcaggagatgcagcagtcctacttattgccatgtggacttgtgggaaggacacgtgtgacccttaagaatccagtttggattagtgtttgaaattgaattgggaatgttgttccaggatgtggaatgcagccgtgatcacacttaccgagcttactttgatctgtttgtcaatagcatgcaaaaaatgctttgtttgccctttgcttctgctttttttcagggaagctgccaaagaatgtcgacgtcgaaagaaagaatatgtaaaatgtctggagagccgagttgcagtgctggaagtccagaacaagaagcttatagaggaacttgaaaccttgaaagacatttgttctcccaaaacagattactagaaatatttaactatgaactgaaggcagcatgtatagttgcttttgaaggaatacaatatatagctggcaagaatggtggcttcttttctttgtatcattcatcttcttctttaatcacttaacattcctaaaatgcttcactgtacgtagttaagtcgtagctataacttcaaattttttaaaagagacaaactgtaaaaaatgtgtgtattcttaaaatgcaatatttgtaaggcttgttccaatgccacatacttgcagctcccattctatgtgtcatcaatagtgtcctatgcaataaaattatttgcaggtctttaaatcattttaggaaaggatgatcaaaaataa

SEQ ID NO: 113834 - DNA, 721 bp, Homo sapiens
  Payload ID: 2233
  Gene Symbol: CREM
  Gene Name: cAMP responsive element modulator
  ENST ID: ENST00000469949
  CDS Start-End: 97-276
gccgctgctgagcggcggtcgggctcgccgtctccacctcctcgcgtccgtaatcagtgacgaggtccgctacgtaaatccctttgcggcggacaaatgaccatggaaacagttgaatcccagcatgatggaagtataacagcttctttgacagagagcaagtctgctcatgtgcagactcagactggccaaaattcaatccctgctttagctcagtgcacaatgtgtaaggagtccctcggaataaagcagccctggcatgccatcggggattgaagtaggaacgatttaacaagggatacttggaaatgttgtcatgtgcgagttgtaaattttcttttttaatctggtggaaaattggaatggcatttctctgttttgcccagctatgccaaaaatcttcttggtcccacataggcctaggaaggatgtagatggcaatcacaaaacaaacaaaaaatgagcaaacaaatagaagacctcaagcaacattttctcttgttaataggttagcaacctcatatttgtatattaaagagatctgcattatgttaggttgatttcatataatttcagctaagtagatctagtttaaggtcagtgttttattgaatcttgtattttagcttcagtatattaatttccttagctgagggactcctactgaaggagaaaagtgttcctgttaaaattttgaaataaaagtttctgttttactgta

SEQ ID NO: 113835 - DNA, 5301 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000249822
  CDS Start-End: 273-611
ggaaaaaaggaagtgtttggacgacagcgagcgggagaagcggggtcaagtaggtaggggtgcggtgcgggaggggcaggcgggctccggcgtgcgagggccttggccagcggagcgtttcgcggctccgtgtcgtcataaggcggcggccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtctcgaactcctgacctcaggtgatccactcgcctcggcctcccaaagtgctgggattataggcatgtgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaa

SEQ ID NO: 113836 - DNA, 3245 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000561650
  CDS Start-End: 548-838
gtgagccctgggccctgcccaaggccgggtctggcgggcggcctgctcccgccaggcggagggccgcgcccgagatgcggggccgaggcgcatgaggccgaggctcctgcgccccacctttggcttcccgccgtcgctggctggtgcgccgacgaattgggagttccaacgtgccccgcgtttactccgaatcgtgccttttgtaacacctccgtgggtcgcggtgttcctcagtcacttatatttacgcgagagcccaggacgcaggctttgggcgtagagcctaagtttttctgtaagcctcaatttggttaggaagttttattttttcctttgaagaactctccaactacttgtattgtgagcgtgcggttcactccaaaagcagtgcctcgtgtgcgggccgcgatgtgggccaggattggcatttcagggccaacccttgtaaccatggtcagtgagtaaagtccggccttcagtgtcttcacctgtaaaggccgaatactggtgcttgcctcccacggcggggtgaggcctagaggaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttatt

SEQ ID NO: 113837 - DNA, 661 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000569281
  CDS Start-End: 61-399
gaaggaaaaaaggaagtgtttggacgacagcgagcgggagaagcggggtcaaggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtag

SEQ ID NO: 113838 - DNA, 799 bp, Homo sapiens
  Payload ID: 2234
  Gene Symbol: ARPP19
  Gene Name: cAMP-regulated phosphoprotein, 19kDa
  ENST ID: ENST00000561971
  CDS Start-End: 279-674
tagagggcaatcttatttccaagtttctgagggacactttgttggaaccaacaaacattgcgagtaactattcagatatcaagtagaatgaggattcagtaagaagccgcaggacttggcaaataaaaaggtcattgggggagctcaatgctagcagtttcggaagcactcggcagccacaaacggatgtgaggtgaggcaggagcggcgacctttgaaggaaaaaaggaagtgtttggacgacagcgagcgggagaagcggggtcaaagggagcactatgtctgcggaagtccccgaggcagcctccgcggaggagcagaagagtgaacacaacatgctcccttggtctctgcaaccatcgattcctaacagcctagaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtag

SEQ ID NO: 113839 - DNA, 718 bp, Homo sapiens
  Payload ID: 2234
  Gene Symbol: ARPP19
  Gene Name: cAMP-regulated phosphoprotein, 19kDa
  ENST ID: ENST00000564163
  CDS Start-End: 124-519
ccattttcgcgggcggaggcggcccggcgggccctgggagagctgggacgggcggcggccgggtggcctcggccacccgctaattgcatcttttcccggcgtctcgtctgcagagggagcactatgtctgcggaagtccccgaggcagcctccgcggaggagcagaagagtgaacacaacatgctcccttggtctctgcaaccatcgattcctaacagcctagaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacat

SEQ ID NO: 113840 - DNA, 745 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000567669
  CDS Start-End: 67-405
gaaggaaaaaaggaagtgtttggacgacagcgagcgggagaagcggggtcaagtagagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctt

SEQ ID NO: 113841 - DNA, 550 bp, Homo sapiens
  Payload ID: 2234
  Gene Symbol: ARPP19
  Gene Name: cAMP-regulated phosphoprotein, 19kDa
  ENST ID: ENST00000569723
  CDS Start-End: 50-265
aagtgtttggacgacagcgagcgggagaagcggggtcaaagggagcactatgtctgcggaagtccccgaggcagcctccgcggaggagcagaagcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaag

SEQ ID NO: 113842 - DNA, 5362 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000566423
  CDS Start-End: 135-473
agaaactacaattcccaggaagcactcggcagccacaaacggatgtgaggtgaggcaggagcggcgacctttgaaggaaaaaaggaagtgtttggacgacagcgagcgggagaagcggggtcaaagggagcactatgtctgcggaagtccccgaggcagcctccgcggaggagcagaaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaagtatgcatgtgcattaactgttgaattcacttttgtgccatttttgtaaatacagtagttttgcacaacctctcacaaatgtctgtattaatttcacatacttaaaaagtagataatgtgccaaccagaagcacaagagttcctacacaaaactctgtaaatcattatagcttttgtataataagagtagtttacaatctcgggcttatagaataccaaactgaaatcttagttcaatctgccatagacttaagcttttcatttgttactaatatccatgacattcagtggccttgtgcaaatacgatatgttgcttaggcatatcttttgtcctatgcagaacctttcattttgatttttatgaaagttgcaattcatgtaatttatataaactttttaaatgtagaaactttttacttccacactcagttttggagaccctagaataaaaggcttcaatactctgcattccatgccctctgccacctgcttttttttcccctttgttctttgactcaaatggtattgagctgtttgttgtatatggaagcataggtgtctatatccttactcttttatataacacaataatggcgttttccttctaatttctcagttgttaacttctttctcttttttttttaggatagggccttgctctgtcacctgagctctagtgcagtagtgcaatcacagctcactgcaaccttactcctaggctcaagttaactattcttgatcctttattattactaatattctacaattgtttaaataaaaggaactttataatgaaacggttcggaatactggctcaagaacctatgtcaagatgagctgaattttggtaaattattttaggaattatgacaagctaattgaattaggcttgtgacaattagagtaatttacatgacaggtaaaactcctattaaaaatgtttagatgtttgcttctgtagatgtcactttagtaaaataccaatttagttttacttgtggcttatctagttagaacttagcagactttactgggacaagtttactgctcttgtaggagctcctctcacaagtagttgtaatgctgtagcatgatactcaggatcagtagcttgagatgctactatttttctcttcatctttgacttgcagagagcctcccgtttttggatccaggcatcttttctgaatcctggttccatcagtatacctgctctcctatgaccccaaatcatagtcaatggtgcctcaaacatagcaccttaagttaaaggctgcctagtgctctgaggaaagcttgctgattatcttcctgatctactcaccccaaaaggcagaaaagcaacacagtcactgctgtggtcatttgtaatgtaaagatcagttatatatatatatttgtaatgagagcaagtatatactcattatagaatcaatttaagaagtttaaaataacccagagtagaatttctatatctagtcttggtttttttcatgaatatttgcaagtaattaccattaaattcacacatgaaagattaatctgaaagatcagagaccatgttattcctgaccacgatagaactgctcctgtggtttgggacaagtaataaaacaactgcttgagttttgtttgtaaaatacataattaatatttgacctacctcaaaatgtattgaggatctgtgaaatgctaagtgcccaaaataaaatattgctgattgtctttttattaaaagtaaatttcctcattaagccaacctgccttctgtaagtcacagtgcttaaatctcaggatttttcattaggagagacctgtcgttaaggatttgtaggtataattgcttagcctccattattggtgcttgggatagagaggttttagatttttgttttttttttgttctgcctcaaagctcagtttattgaagacatttgtaagctattggatcatcacttgaatcaagattttgactagtgagcttaattgtccatttcttacaatttcaaagttacagtctcagaaatggttaattttaataactgtcctatcataaattaatgttggaataaattgaagttgttgataaatacttcatgaaaactaaagtctgaaataaattacttgttttatgtccaatagctactacatttgatagaacagttttgaggaacatttcattcttgaacgcagcatctgacatggttctcagcaagttggaatagtaaggattattggcttgtttcgatgagtggaagcggcatgtttgtagcatacaagttattcaataatcttgtgctgatgacctaaaaatatgtcttaactattcatcaaggaaagcctggtgaagcctttacttgttactacttcaacagttggaattagttgctctttttacttgatgaaacaaaactatacctctgaatatttatggatactttttactaaatcaggcttgtgttcttaatccaaattagtaaagttttatggaagctgaaatgtaatacagtagtctccccttatctgtaagagatacattccaagacccctagtggatgcctgaaacctcagatagtactgaaccctttatcaactatgttttttcagtctgacaaccaaggcggctactaagtgactaaggggcaggtagtatacagtgtggataagcaggacaaaggggtgattcacatcccaggcaggacagagcaggagatcatgagatttcatcactcaggatggcttgtgatttattttattttattcttttttttttttgagatggagtctcactcttgcccaggctggagtgcagtggtgcgatcttggctcactgcaacctctgcctcctgggttcaagcagttctcctgcctcagcctcccaagtagctgggattacaggcgtccgccaccatgcccagccaatttttgtacttttagtagagatggggtttcaccatgttggccaggctggtctcgaactcctgacctcaggtgatccactcgcctcggcctcccaaagtgctgggattataggcatgtgccaccatgcccggccggcttatgatttaaaacatgaattgtttatttctggaattttccacataatatttttggaccaaggttgcctcaggtaacaaactacagaaagtgaaattgcagataaaggggattactgctcctctgctctaaaattggtgtttgggtgatcagaagcaggtagccaatgggaagagcacttctgagtgataactaaagcagtttggtggccttttcacattctccaatgttcaaacatattttccactttccattttctctttcacctcattttgcctctctatcccccatccctgcttatttcttaagcccattgatggcactcattaaattgtatttagggctaatgagtcattgttccttaatatcgttttcaatatgccacaatttaggacacatttaaaattttctaaaacaatatcctaatcaatattgactaatttgagccacattcccaactctaactcagcacacactgccagtcttccccaatatctgtctcctctcaattccccaccacaccttataaaattgtaatcaaagatatctcactctgtcattgttaatctaagaataaaaacactgactttaatacggttttactaagtttcaaccttctaattaggtaggcctctaggtattctgcagatcactgctggtcttgatagccattaatatatgtttgtattatgttatttttcaactaaatcgcagttggaaaaaaacatatttaatattatgcccttggatctgttactgcatcactagcacttgtgatgcaatagaacacttcgcctgtactgaaagggccaagagtaaatgccttgttttgtttttttgttttgttttgttttgctttttgttaaaacatgtctatagagttggcagttaatgctgaatttgtcaaataccccttccaaaattatacttgtatttaaaaaataaatggatctacctaatttctattgatttaatttgcagttttgtcttattaaagtggtatgtttttcagtgtattttttctgaagttgatctctttacatttcagctattactgtatgcaggaagaaactgacttgtaatctttgattttttttttttttttgcatttgtaaaggctttgtacttaaggtaggattaaatgtttgcagattgtga

SEQ ID NO: 113843 - DNA, 955 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000563277
  CDS Start-End: 98-388
agccacaaacggatgtgaggtgaggcaggagcggcgacctttgaaggaaaaaaggaagtgtttggacgacagcgagcgggagaagcggggtcaagaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcc

SEQ ID NO: 113844 - DNA, 275 bp, Homo sapiens
  Payload ID: 2234
  Gene Symbol: ARPP19
  Gene Name: cAMP-regulated phosphoprotein, 19kDa
  ENST ID: ENST00000567830
  CDS Start-End: 60-275
gaaggaaaaaaggaagtgtttggacgacagcgagcgggagaagcggggtcaagtaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcact

SEQ ID NO: 113845 - DNA, 568 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000563566
  CDS Start-End: 113-403
gaaggaaaaaaggaagtgtttggacgacagcgagcgggagaagcggggtcaaagtgaacacaacatgctcccttggtctctgcaaccatcgattcctaacagcctagaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagttttt

SEQ ID NO: 113846 - DNA, 1489 bp, Homo sapiens
  Payload ID: 2234
  Gene Symbol: ARPP19
  Gene Name: cAMP-regulated phosphoprotein, 19kDa
  Uniprot ID: P56211
  ENST ID: ENST00000568196
  CDS Start-End: 526-816
aatattaaaaatttattataaaaaaacaaatatcaggatcatctgtattcaagaaaaatgtactgataagtaggctgctgttaatttctagtaaagaatctaacttcaaatcatacataattttagataaatagaaaaaattctgtatattttaacagtattaggatgattctctaaatataggcaaagaactgaagagttccatagaaggtgactaactataaatgtattatacatgactggaaaagtaatggcaagcaagacttcagagctgagctatcttgatatttttatccagtgtgtggggtgttacacatgcatcacagctataatagagctatcacatggatcttttgaaaaacaagatagagatgttttaaaggcttctgggtttgatttcttagtcagatgctgtggtacttggcatttaacaactagaattcagaatccagatttttaaaggtgaattattttaaataactgagttgtaatagagaagtaatttatttgaaattattttaggaaatggaagataaagtgactagtccagagaaagcagaagaagcaaaattaaaagcaagatatcctcatctgggacaaaagcctggaggttcagatttcttaaggaaacggttgcagaaagggcaaaaatattttgattctggggattacaacatggctaaagcaaaaatgaagaacaagcaacttcctactgcagctccggataagacggaggtcactggtgaccacattcccactccgcaagaccttcctcaacggaagccgtcccttgttgctagcaagctggctggctgattaagaggctgaactgcatgaatctgctaaatctcattatttctccttaatatgttacttatctactttttatttcctttcattcactagtcatttgagactgacagctttgcaggtagcagtagtgtgtgctgctattgtggaatatacgtgtgtagagtttttgattagtttaacagtgcactggtgaagaggacatgttagagcaacataagtaaactacttgaaaatagttgtatatattacctaacttctagtgtagtactggttctaacaagtaacaagcaagttttaaaattttaatgttttggctttcattacttcatcttaattatagctttgtatgttactcttatttaatataatctctattgtattgatttcttctgtatttaccttttggattttgtaaaacagaagtttaagaccacaagttagaagaaaggtcacatatttcaaacacaactagatggggctctgaaagatttgtatctctgtgcttgaacttgaatggccttaaacctgtttcagctttaacagtagaattttacttgggcaatatttgcccattctggtgtaacttatgtgactctagtgcttaacagctgccgttgaagctaatattcagttctgtagagttagaataccttttgttgttgaagatgtgaatgaa

SEQ ID NO: 113847 - DNA, 3433 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000187397
  CDS Start-End: 457-2895
gtgctattagatttgcaaattgctgatctcccagtgactttccctcttagatcccagttgagtatggttaccttgagaactgtggtattagccatgttagagcatgctccactggggagttctgtgcagtctatttttaatgctatttaatgaaggagcgagcgcctcactcagcaataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagcaaaacagaatgcatccatttagagatgacagacgaagtaaatcaattgaagagagagaagaggaatatcagagagtgagggagagaatatttgcacacgattcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgaccttatggaggaaggtcatgtttttaccaccagtttggttca

SEQ ID NO: 113848 - DNA, 1304 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000396481
  CDS Start-End: 273-542
aacagattttaactctgaaaagccatttccagtgtctatagactattgtgagcctggagaagtagcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcct

SEQ ID NO: 113849 - DNA, 2416 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000396482
  CDS Start-End: 291-560
agagaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttacc

SEQ ID NO: 113850 - DNA, 1015 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000432682
  CDS Start-End: 380-649
gaagaagcaggcagcttgagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagcttaaaaaagtgaggaggaagtaaatgctaaattattcatgagcctcatttgacagcacatcagaaggggaagtgtcaggggttttataaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcata

SEQ ID NO: 113851 - DNA, 2506 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000412048
  CDS Start-End: 379-648
attagagaagaagcaggcagcttgagacaggtggagctggatcaagctgtgaacgtgatttgctggaagctggtcattagtgttagaaaccccgtcttatttatttcatccttcaccctaccatgattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 113852 - DNA, 550 bp, Homo sapiens
  Payload ID: 2235
  Gene Symbol: ARPP21
  Gene Name: cAMP-regulated phosphoprotein, 21kDa
  ENST ID: ENST00000413378
  CDS Start-End: 255-550
gattattgcaattattattatttatttttcatcttttttcaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccag

SEQ ID NO: 113853 - DNA, 787 bp, Homo sapiens
  Payload ID: 2235
  Gene Symbol: ARPP21
  Gene Name: cAMP-regulated phosphoprotein, 21kDa
  ENST ID: ENST00000427590
  CDS Start-End: 1-373
ttgcagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaattcagtttgctcccaggaaagcctttttgtggaaaacaggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggtagttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcg

SEQ ID NO: 113854 - DNA, 620 bp, Homo sapiens
  Payload ID: 2235
  Gene Symbol: ARPP21
  Gene Name: cAMP-regulated phosphoprotein, 21kDa
  ENST ID: ENST00000452563
  CDS Start-End: 332-620
gcagtctatttttaatgctatttaatgaaggagcgagcgcctcactcagcaataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggtatatccccttgccattatcattaatt

SEQ ID NO: 113855 - DNA, 561 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000436702
  CDS Start-End: 180-449
agaagtcgagggtcatttgttcaaaagttggagaaatatcctcttttgttgcttcttctactctgtagtggagaatggggaactggtagttgtgtgggagttatgtgtctctaagatttgtcgacccattttgatggcaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaa

SEQ ID NO: 113856 - DNA, 544 bp, Homo sapiens
  Payload ID: 2235
  Gene Symbol: ARPP21
  Gene Name: cAMP-regulated phosphoprotein, 21kDa
  ENST ID: ENST00000421492
  CDS Start-End: 449-544
aacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagcttaaaaaagtgaggaggaagtaaatgctaaattattcatgagcctcatttgacagcacatcagaaggggaagtgtcaggggttttataaagggcataaaatcttgttattttaatttgcatctgggagaatgtctgagcaaggagacctgaatcaggcaatagcagaggaaggagggactgagcaggagacggccactccagagaacggcattgttaaatcagaa

SEQ ID NO: 113857 - DNA, 700 bp, Homo sapiens
  Payload ID: 2235
  Gene Symbol: ARPP21
  Gene Name: cAMP-regulated phosphoprotein, 21kDa
  ENST ID: ENST00000446068
  CDS Start-End: 1-436
ccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagctttgtccttcagttgtgcacaaattgagctggattatcaatacggaccgatgatcaaccggtgtagctgtaaagaacaaaccttgttatgcaaaacagaatgcatccatttagagatgacagacgaagtaaatcaattgaagagagagaagaggaatatcagagagtgagggagagaatatttgcacacgattcagtttgctcccaggaaagcctttttgtggaaaacagtaggctcttggaagacagtaacatatgcaatgagacctataagaaaagacagctctttcggggcaacagagatggctcagggagaac

SEQ ID NO: 113858 - DNA, 568 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000427542
  CDS Start-End: 239-508
gatgcatttagtgttttcatagataggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggc

SEQ ID NO: 113859 - DNA, 3182 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000444190
  CDS Start-End: 302-2683
aatgtttatgcatagaaatatagctgaggtggatgtggttgctgtcagctattcaggtttgctacctgatcacctcctgaagatgtagggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacaggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgacct

SEQ ID NO: 113860 - DNA, 2880 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000441454
  CDS Start-End: 753-1022
agcatttagttgggatagcttcactagagctgcctgccaaagacttccttccacaggatcttgtcgcaccagcaactgacaggagcttgggagctcgggagcttgggagagggcttatgtttttaataatgtagctgtcagttcgaagcctggaaatgttgaccctcaaaggtttattgccaaaattagataccatatttatgctgaattattaccttttcaatagttttttttgaccttgcagactactgtattctttatacctagggaagcatgtctatgtttggaacctgcaaataatttttcagtcatcttagagatgctgcagaacatcaatgccacatcttgagtcagaagtcgagggtcatttgttcaaaagttggagaaatatcctcttttgttgcttcttctactctgtagtggagaatggggaactggtagttgtgtgggagttatgtgtctctaagatttgtcgacccattttgatggcaaggtgtattcacaagtgtgtgtaaagggggtgtggatgggacaactgcatctgcctcttgtgcatgccttgggtacttgatttcatcttgttttttcccccttttgtataaaattctcaaaattgctcatttggatttgaatatgaaaggagaaatgaaatctctaaagaatgatagtaaataccttgcactgactttattttctgatatcttaaccttctagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 113861 - DNA, 781 bp, Homo sapiens
  Payload ID: 2235
  Gene Symbol: ARPP21
  Gene Name: cAMP-regulated phosphoprotein, 21kDa
  ENST ID: ENST00000425289
  CDS Start-End: 1-781
attttgcagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaattcagtttgctcccaggaaagcctttttgtggaaaacagtaggctcttggaagacagtaacatatgcaatgagacctataagaaaagacagctctttcggttggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggtgag

SEQ ID NO: 113862 - DNA, 590 bp, Homo sapiens
  Payload ID: 2235
  Gene Symbol: ARPP21
  Gene Name: cAMP-regulated phosphoprotein, 21kDa
  ENST ID: ENST00000438577
  CDS Start-End: 308-590
agcaataaaagaagcatgagggaagacagagcagtgcatggttatggatactggacaaggatatttggaaaggtaaaggctgaccattggatatggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagcttt

SEQ ID NO: 113863 - DNA, 657 bp, Homo sapiens
  Payload ID: 2235
  Gene Symbol: ARPP21
  Gene Name: cAMP-regulated phosphoprotein, 21kDa
  ENST ID: ENST00000449196
  CDS Start-End: 496-657
tttgttaaaaatcagaaaacctttgacacacttttagataaatacacctactcctttgatcctttgtgtatgtattaccacagggcttaaatatcttaagattttagttaatgtcattttcatgaaagacagtcatttggaagccaagagctctatctatgttttgttcaaatagccgagtaatctactatcttggcagtaattacttctgctgcatttctaatgtgaattgcatgtgagagcttatgaatacactcttttcaagtgtatgtgggttttcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaaga

SEQ ID NO: 113864 - DNA, 1103 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000438071
  CDS Start-End: 105-374
attcacaagtgtgtgtaaagggggtgtggatgggacaactgcatctgcctcttgtgcatgccttggggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaag

SEQ ID NO: 113865 - DNA, 611 bp, Homo sapiens
  Payload ID: 2235
  Gene Symbol: ARPP21
  Gene Name: cAMP-regulated phosphoprotein, 21kDa
  ENST ID: ENST00000450234
  CDS Start-End: 300-611
agagttggcctggagagtgagcggtggagggagtggaacaaggcttcgtcaagagtccccaggagtccaggggcgcccccgagacgggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggat

SEQ ID NO: 113866 - DNA, 2014 bp, Homo sapiens
  Payload ID: 2235
  Gene Symbol: ARPP21
  Gene Name: cAMP-regulated phosphoprotein, 21kDa
  ENST ID: ENST00000457165
  CDS Start-End: 1-726
gggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacattatagagttttcttttttaatggatatatactgtattgtagtgtttaatcaaaataaaactatttgacctta

SEQ ID NO: 113867 - DNA, 3086 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000417925
  CDS Start-End: 215-2656
aggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggaatcaattcatttacagctttccagtttttccagcctgcaagaggaggataaatctaggaaagatgactctgaaagagaaaaagaaaaggataaaaacaaagataaaacctctgaaaaacccaagatcagaatgttatcaaaagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcgtatcagaggatgcttgtccatcgagtggcagcttattttggattggatcacaatgtggatcaaacaggaaaatctgttatcatcaacaagaccagcagcaccagaataccagagcaaaggttttgtgaacatttaaaagatgaaaaaggtgaagaatcccagaagcggtttatcttgaagcgagataactctagtattgataaagaagacaatcagtcagtttgctcccaggaaagcctttttgtggaaaacagtaggctcttggaagacagtaacatatgcaatgagacctataagaaaagacagctctttcggggcaacagagatggctcagggagaacatctgggagtcgacagagcagctcagaaaatgaactcaagtggtctgaccaccaaagggcctggagcagcacagactccgacagttccaaccgcaatctaaagcccgccatgaccaagacggcgagttttgggggcatcacggtgctgaccaggggtgacagcacttccagtactaggagtaccgggaagctgtccaaagcaggttccgagtcttccagcagtgcaggctcctcaggatcgctgtcccgcacccatccacctctccagagcacacccctagtctcaggtgtggcagctggctctccaggctgtgtgccttatccagagaatggaatagggggccaggttgctcccagcagcaccagctacatcctccttccacttgaagctgcaacaggcatcccgcctggaagcatccttcttaatccacacacaggccagccctttgtgaatcccgatggaactcctgcaatatacaacccacccaccagtcagcagcccctgcgaagcgccatggtggggcagtcccaacagcagccaccacagcagcagccctccccgcagccccaacagcaggtccagccaccgcagccacagatggcaggccctctggtcactcagtctgtccaggggctgcaggcttcctcccagtcagtgcaatatccagcagtctcttttcctccccagcacctcctacctgtgtctccaacgcagcactttcccatgagagatgatgtggcaacacagtttggccagatgaccctgagccggcagtcctcgggggagactcctgaacccccatcaggtcctgtctacccatcctcccttatgccacagccggcccagcagcccagctatgtaatcgcctctacaggccagcagcttcctacaggaggattctcaggctctggccctcccatctcccagcaggtcctccagccccctccctcaccacagggatttgtgcaacagcctccgcctgcacagatgcctgtatattattacccatctggtcagtaccctacctcaaccacgcaacagtaccggcccatggccccggttcagtacaacgctcagaggagtcaacagatgccacaggcagcacagcaagcaggttaccagccagtcttgtctggtcaacagggattccaaggcctaataggagtgcagcagccacctcagagtcagaacgtgataaataaccaacaaggaactccggtgcaaagcgtgatggtttcctacccaacaatgtcttcttatcaggtgccaatgacccagggttctcaaggactgccccagcagtcataccaacagccaatcatgctacctaaccaggcaggtcaagggtcactcccagccactggaatgcctgtttactgtaatgtcacaccgcccacccctcagaacaaccttaggctgattggcccacactgcccctccagcactgtcccagtgatgtcagctagctgcagaacaaactgtgcaagtatgagcaatgctggttggcaggtcaaattctgagagctctggctgtggtacatttcttcagatatttctcatggcctttgatggaagaggaacaaggtgggaaaactggctgaggacttaagtattcactcaacactcaaatgattgctgctggtattctgtaaaaaataaacaaagactaatatacacgttagctggttaatggtgcatatttctgtcatgtctgctaggtatgcctttatagcttagctagtgacatgaattcatcaaggtaagattttctcctaccactgaataccactgtgtagattataatatccctaatttggattagttttgtactttgtgttgagtttgtgatgctaaaagtatttaaaaattatatactaaatcacattgtaccaaagctgtaatggaaaagcaaagaagaattgatgaattgaaggaataatttatatacatt

SEQ ID NO: 113868 - DNA, 574 bp, Homo sapiens
  Payload ID: 2235
  Gene Symbol: ARPP21
  Gene Name: cAMP-regulated phosphoprotein, 21kDa
  ENST ID: ENST00000432450
  CDS Start-End: 271-574
gagacaggtggagctggatcaagctgtgaacgtgatttgctggaagctggtcattagtgttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcaggtatatccccttgccattatcattaattgcatgaatgggatcc

SEQ ID NO: 113869 - DNA, 3150 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000428373
  CDS Start-End: 1023-1292
gggtgggactggcagagctacggacaggtgggagcagtcagacagcctgagagagggagaccagaacgcaaagagagcgagagcattaagtaggcagggagaggcacacagaaagatagacagcaacactcgcgtgctccctccctccacacgccctcctcttaccgagcgaagcggccaggggcacagagtgggagaggactgtgggcacagaagaccggaagagggacgctgcattgctggtgggacggagggattcggacggacggacagaccagcgcacagactggcagcctgcgagagtggcagctttgagagcagagcgcagcaaagcgagaatcccgcgccgagctgctagtcggacccacagacggtcggactgacagacgtgcagacggacagaagagcagacaggaggcgggggcgcgttcactcccggcggccagccggccagagaaggcggcggtggcaccttctgagcgcgtccggagcagagaccagcagcagcaggggcagcggggacacaagccgcgaccgagccgccgccgcagccctggctgccacagctgtgtgggatcccagccgacactgcagaaagctccttttactagcagttaaataaatcgaccaaaaacaaaacaaacaaacaaacccaacaacaacaacaacaacaaaagccaagccaaaagccaaaacaaacaaatccagccaaatcaatcattgagaaacaataatattaataaaatccaaaactaaatcaaaccaatcaaggcaccaagacgcaggggggatatccacagttcgatcaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaaggaattcaaaagaatttagattaaaagttaaataaaaagtaggcacagtagtgctgaattttcctcaaaggctctcttttgataaggctgaaccaaatataatcccaagtatcctctctccttccttgttggagatgtcttacctctcagctccccaaaatgcacttgcctataagaaacacaattgctggttcatatgaaacttaggaaatagtgaataaggtgcatttaactttggagaaatacttttatggctttggtggagatttctcaatactgcaaaagttgtccagaaatgaatctgagctgatggtgactttaagttaatattattaatatatcactgcatatttttacccttatttttgctccttacagcaagattagtaggttataaaaatttaaatttaaacaaaattatttcatgacaaaatgggaaacttcacatcatacttatttttgtttgcctttcaggcatcatattagcttttataaaaaatggtcttgctgctgaaattgtacttattttatcagaggctgggtgcagtcaagacaaaagtaaaatggtttacctgagcccaggggagggaaaattgattaagatatcattatttttgtttggtttggttttgcttttttcctcttactttaattgaaatactctgaattcccctcatggaaacagagagcattgagagcactttctttaaaaggaccaaaaataaattcctaatagattttgtcctaagagagtgtttttttttctagcatcattttctttacatgccactcatgtcataaggcatggacaggctatctttcagtggccattactatgtttcgtacacatgctttattttacttgggctctgagaaatgtgtggctttccttcagcattttatttgtgcttctctttttaatggagattgaaaagggagaataatgtgaatatcacggcttatattattaaatgttgattgatggcttgtaatgtactgcacacaatatatgttaactctgcagaatgacagaccctgggagaagtaatgccccagttgtcccccactcctaatgccaggcagagaaggacagcctttatagacttaatctgctttttgtcccatttgacaaggtaccaggaggaaattttttaagggatcaactgtatcacagtgcccactctggacctaagtctagtgtatccatacaattggtgcagagaaataaggtgtaaatggtgctttgttcctgctggttccaagctcagaaaccaagactagctttgtaggagagaatgagagcctgcaagcctctctttggattggctgaggagtggtgggagcagggggttgatagaaaacatccagacacacatataagcaagtggccgtgctacctttttagagaataaagaaacagacttttgagtttatatgcaatgccttcattaggtaccaccggcacttacaaaatgtgcggactgaatcccagagaacactggcagatgtatacagtatatggattgtatcgcttccccaatgtttgtaaattcacagtatttggaaaactgccttcattttccagtgtgggaaaaactcttgctacctgtattacttgatctcagacccatacctgatggttcagtctgtccttaagttaaaagaattttgcttttctaatgttatactatttacctgtcagtgtattactgcaacttgaatcactcttttactgttgttggatataaacttatcctgtaccaatgtatttattaacacttgtattttattattgagcatatcaataaaaatattaaaaaataacagattgttttttaccaa

SEQ ID NO: 113870 - DNA, 543 bp, Homo sapiens
  Payload ID: 2235
  Gene Symbol: ARPP21
  Gene Name: cAMP-regulated phosphoprotein, 21kDa
  ENST ID: ENST00000419330
  CDS Start-End: 415-543
acaatatacaaggtagccagaagtgaatatgattgagaattctcattagtgtgaggagacagtttgaagtccataaggttggaaattgcaaattaatcatttgtatataagtcagtttaattcagatctgctttgtgacaaggttaggagagaatgtggggcttaaaggtgatgtcgacaatgaaagccatttcttcttatggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcag

SEQ ID NO: 113871 - DNA, 715 bp, Homo sapiens
  Payload ID: 2235
  Gene Symbol: ARPP21
  Gene Name: cAMP-regulated phosphoprotein, 21kDa
  ENST ID: ENST00000414496
  CDS Start-End: 282-578
aataaaagaagcatgagggaagacagagcagtgcatggttatggatactggacaaggatatttggaaaggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagattgcagccaagaatacacggattctacaggcatagacttacacgagtttctgattaacacattaaagaataattccagggacaggatgatacttttgaaaatggagcaggaaattattgatttcattgctgacaacaataatcattataaaaagttccctcagatgtcatcg

SEQ ID NO: 113872 - DNA, 572 bp, Homo sapiens
  Payload ID: 2235
  Gene Symbol: ARPP21
  Gene Name: cAMP-regulated phosphoprotein, 21kDa
  Uniprot ID: Q9UBL0
  ENST ID: ENST00000474696
  CDS Start-End: 286-555
cattagagaagaagcaggcagcttgagacaggtggagctggatcaagctgtgaacgtgatttgctggaagctggttgacgatgtgtcacactgtgtaagggaatcgcatggagatgggcattccgaactgttaatggggacatgggactccagttgtctctgatcacttgtgtggattttcctggcgtagaacgacagaagccgctagtaagtcgccaagacctacagcaggaattctgcaccaaagggcataaaatcttgttattttaatttgcatctgggagaatgtctgagcaaggagacctgaatcaggcaatagcagaggaaggagggactgagcaggagacggccactccagagaacggcattgttaaatcagaaagtctggatgaagaggagaaactggaactgcagaggcggctggaggctcagaatcaagaaagaagaaaatccaagtcaggagcaggaaaaggtaaactgactcgcagccttgctgtctgtgaggaatcttctgccagaccaggaggtgaaagtcttcaggatcagactctctgaaaactgcaaatggaaag

SEQ ID NO: 113873 - DNA, 2821 bp, Homo sapiens
  Payload ID: 2236
  Gene Symbol: CAGE1
  Gene Name: cancer antigen 1
  Uniprot ID: Q8TC20
  ENST ID: ENST00000296742
  CDS Start-End: 722-2647
tggatgttctgtgctctcaggaaggcgtgttgagtagccggcacggcgaggcccgtgctggccgtttcttcccggagttttcgtttctgtaccccactttgtgtttactgcggcaggaggcgccagctagcccacaggctgttcggcctagggggtcgtaccttcctaacttcaccactctctgggaagacaccgcacccacagtagggtcgctcgggcctcgcgggctgcacctgtctctgcggagttcccccggcgcgggcggacgtcacacaggggcgttccagcactccgggagcccgattgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagaggtcatagactgtgattcagatgaagccaagagtatcagagatgtacctacccttctgggagccaaactggataagtaccacagtctaaatgaggagcttgatttcttggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataa

SEQ ID NO: 113874 - DNA, 2771 bp, Homo sapiens
  Payload ID: 2236
  Gene Symbol: CAGE1
  Gene Name: cancer antigen 1
  Uniprot ID: Q8TC20
  ENST ID: ENST00000338150
  CDS Start-End: 229-2703
ttgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtcatagactgtgattcagatgaagccaagagtatcagagatgtacctacccttctgggagccaaactggataagtaccacagtctaaatgaggagcttgatttcttggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgttggcatataacttgtacatatttataggatacaggctgggcgcggtggctgacgcctgtaatcccagcactttgggaggccgaggcgggtggatcacttgagttcaggagttcaagaccagcctgaccaacatggggaaccctcgtctctattaaaaatacagaaaatt

SEQ ID NO: 113875 - DNA, 2877 bp, Homo sapiens
  Payload ID: 2236
  Gene Symbol: CAGE1
  Gene Name: cancer antigen 1
  ENST ID: ENST00000379918
  CDS Start-End: 225-2678
gagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaagctactgaaacataaagatagaatcacaacctttagagagttaattgctaaggaaaaagcatttcaagatcatgctattaaggtcatagactgtgattcagatgaagccaagagtatcagagatgtacctacccttctgggagccaaactggataagtaccacagtctaaatgaggagcttgatttcttgatcacaaaactgggacatctcctagagtcaaaagaaaaccactgcaacagactcattgaagaaaatgacaagtatcaaagacatttaggcaacttaataaagaaggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataatcaaatatattctatttaacataaa

SEQ ID NO: 113876 - DNA, 2989 bp, Homo sapiens
  Payload ID: 2236
  Gene Symbol: CAGE1
  Gene Name: cancer antigen 1
  Uniprot ID: Q8TC20
  ENST ID: ENST00000458291
  CDS Start-End: 213-2315
gtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtattccaaggagtatgaaatgattgaaagtgagaacaaatatatttaatctcaggtcatagactgtgattcagatgaagccaagagtatcagagatgtacctacccttctgggagccaaactggataagtaccacagtctaaatgaggagcttgatttcttgatcacaaaactgggacatctcctagagtcaaaagaaaaccactgcaacagactcattgaagaaaatgacaagtatcaaagacatttaggcaacttaataaagaaggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataatcaaatatattctatttaacataaacag

SEQ ID NO: 113877 - DNA, 2832 bp, Homo sapiens
  Payload ID: 2236
  Gene Symbol: CAGE1
  Gene Name: cancer antigen 1
  ENST ID: ENST00000442019
  CDS Start-End: 202-930
gtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtcatagactgtgattcagatgaagccaagagtatcagagatgtacctacccttctgggagccaaactggataagtaccacagtctaaatgaggagcttgatttcttgatcacaaaactgggacatctcctagagtcaaaagaaaaccactgcaacagactcattgaagaaaatgacaagtatcaaagacatttaggcaacttaataaagaaggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaaggg

SEQ ID NO: 113878 - DNA, 1781 bp, Homo sapiens
  Payload ID: 2236
  Gene Symbol: CAGE1
  Gene Name: cancer antigen 1
  ENST ID: ENST00000512691
  CDS Start-End: 108-1781
gagtttgtgagagtccttggtggaggaggttggaaagcgttctccctcccacaaaacccggtgcagagggagggagagccaggtccgtagcgtgggtccaagaaactatggatcctggaaaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaa

SEQ ID NO: 113879 - DNA, 3284 bp, Homo sapiens
  Payload ID: 2236
  Gene Symbol: CAGE1
  Gene Name: cancer antigen 1
  Uniprot ID: Q8TC20
  ENST ID: ENST00000502583
  CDS Start-End: 566-3085
cggagctctctggatggcgcgctgtatagggctgtggatgttctgtgctctcaggaaggcgtgttgagtagccggcacggcgaggcccgtgctggccgtttcttcccggagttttcgtttctgtaccccactttgtgtttactgcggcaggaggcgccagctagcccacaggctgttcggcctagggggtcgtaccttcctaacttcaccactctctgggaagacaccgcacccacagtagggtcgctcgggcctcgcgggctgcacctgtctctgcggagttcccccggcgcgggcggacgtcacacaggggcgttccagcactccgggagcccgattgcgagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagaagtcttctattgttcaacagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagagctactgaaacataaagatagaatcacaacctttagagagttaattgctaaggaaaaagcatttcaagatcatgctattaaggtcatagactgtgattcagatgaagccaagagtatcagagatgtacctacccttctgggagccaaactggataagtaccacagtctaaatgaggagcttgatttcttgatcacaaaactgggacatctcctagagtcaaaagaaaaccactgcaacagactcattgaagaaaatgacaagtatcaaagacatttaggcaacttaataaagaaggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaaacaagcctgaagattaaacagtaatcatttttgtcaaccactccaggaagagtcattactacatatgctagccaaatcaatccatgcagatgatatattaaaatctgtataaagggtaaagtcttacattccaaagatgtgattacttttcttctaatttcttcctgtgaataatcaaatatattctatttaacataaa

SEQ ID NO: 113880 - DNA, 2537 bp, Homo sapiens
  Payload ID: 2236
  Gene Symbol: CAGE1
  Gene Name: cancer antigen 1
  Uniprot ID: Q8TC20
  ENST ID: ENST00000512086
  CDS Start-End: 204-2537
gagtttgtgagagtccttggtggaggaggttggaaagcgttctccctcccacaaaacccggtgcagagggagggagagccaggtccgtagcgtgggtccaagaaactatggatcctggaagtgagcacacttttgtgtcttaaaaagtttggtgtctcgttttgaggtgaaaaatgaatgagataagtgctttttaaaaagttatgaacaaggactatcaaaaattttggtcatcaccttcagatcctgtacattttgaagtggatacttctcatgaaaaagtagaaagcatgtcagaatcggataccatgaatgtcagcaatctttctcaaggtgtaatgctttcacattctccaatctgtatggaaaccaccggcaccacttgtgacttgcctcagaacgaaataaagaattttgaaagggaaaatgagtatgaatccacactttgtgaagatgcttatggcacactagacaatttgttaaatgataacaacattgaaaattactcaacgaatgcactaattcagccagttgacaccatcagcatatcttccttgagacaatttgaaaccgtttgcaaatttcactgggtagaagcatttgatgatgaaatgacagagaagccagaatttcaaagtcaagtgtataattatgcaaaagacaacaatataaagcaagactcatttaaggaagaaaatccaatggaaactagtgtttctgcaaatacagaccaacttggtaacgagtattttagacagcctcctcctagaagcccgcctctaatccactgcagtggagagatgctgaaatttacagaaaagtcactggctaaaagtattgccaaggaatctgccctcaaccctagccaacctccaagcttcttatgtaagactgcagttccttcaaaagaaatacagaattatggggagattcctgagatgtcagtcagttatgaaaaggaagtcacagcagagggtgtggagaggccagaaattgtctcaacttggtcttcggcaggcatttcctggaggagtgaagcatgtcgggagaactgtgagatgcctgactgggagcaaagtgctgaaagcttacaacctgttcaagaggacatggctttaaatgaagtcttgcagaaattaaaacatactaacagaaagcaggaagtgcgaatccaagaactccagtgtagtaacctgtatttagagaagagggttaaagaactacagatgaagattaccaaacagcaagtgttcattgatgtcatcaataagctaaaggagaatgttgaagaattaattgaagacaaatacaaaataatcctagagaagaatgatactaaaaagacattgcagaatttggaagaggttttagctaacacgcaaaaacatcttcaggaatccaggaatgacaaggaaatgttacagcttcaatttaagaagatcaaggctaattatgtgtgtttacaggaaaggtacatgactgaaatgcaacaaaaaaataaatctgtaagtcagtatttagagatggacaaaaccttaagcaagaaagaagaagaggtagagagactacaacaactcaaaaaagaactggaaaaggccacagcttctgctttggacttgttgaaacgggaaaaagaggcccaagaacaagagttcttgtctttacaggaggaattccagaaacttgaaaaggaaaacctggaagaaagacagaaactgaaatctagacttgagaaattgctcactcaagttagaaatttgcaatttatgtctgaaaatgaaagaacgaagaatataaaacttcagcagcaaatcaacgaagtaaaaaatgagaatgcaaaacttaaacagcaggttgcaaggagtgaagagcaaaattatgtccctaaatttgagacagctcagttaaaggatcaattagaggaagtcttgaagtcagatattaccaaggatacaaaaacgacacattctaatctgctcccggattgctcaccttgtgaagagaggctgaatcctgcagatataaaaagagcttctcagctggcctccaaaatgcacagtcttctggctctgatggtgggacttctcacatgccaggacatcatcaattctgatgctgaacatttcaaagagagtgagaaggttagtgatataatgctgcaaaaactgaagagcctccatcttaaaaagaaaactttagataaagaggtcatagactgtgattcagatgaagccaagagtatcagagatgtacctacccttctgggagccaaactggataagtaccacagtctaaatgaggagcttgatttcttggttacatcatatgaagaaatcattgaatgtgctgaccaaaggcttgcaatatcccactcccagattgcacatttggaagagagaaataaacatttagaggatttaattagaaagcccagagaaaaagccagaaaaccaagatcaaaaagcttagaaaatcatccgaagtccatgaccatgatgccagctctttttaaagaaaatagaaatgatttagattaa

SEQ ID NO: 113881 - DNA, 2361 bp, Homo sapiens
  Payload ID: 2237
  Gene Symbol: CASC1
  Gene Name: cancer susceptibility candidate 1
  Uniprot ID: Q6TDU7
  ENST ID: ENST00000320267
  CDS Start-End: 83-2233
gtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 113882 - DNA, 2445 bp, Homo sapiens
  Payload ID: 2237
  Gene Symbol: CASC1
  Gene Name: cancer susceptibility candidate 1
  Uniprot ID: Q6TDU7
  ENST ID: ENST00000354189
  CDS Start-End: 37-2109
gcagtggagcttgactcttaatggtgagcaaggcaaatgaggcagacaggtggaggggcgaccactgattctgcttcaccagtgttaaataatgtaatcaagagccagtcatattttacagcgaagcgggtcggtttgggaaataactcataccttggggtgggtcggccctcttctcagcaatggctttccttacctggaccaggcggacagggtcccaaagcaaaaaagtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 113883 - DNA, 2363 bp, Homo sapiens
  Payload ID: 2237
  Gene Symbol: CASC1
  Gene Name: cancer susceptibility candidate 1
  ENST ID: ENST00000395987
  CDS Start-End: 67-2235
gggagcgtttgtccacacaatttctgctccgactctgcggactactgcagtggagcttgactcttaatgggtcccaaagcaaaaaagtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 113884 - DNA, 2417 bp, Homo sapiens
  Payload ID: 2237
  Gene Symbol: CASC1
  Gene Name: cancer susceptibility candidate 1
  Uniprot ID: Q6TDU7
  ENST ID: ENST00000395990
  CDS Start-End: 259-2289
gtcgtccgggcaacccgggagcgtttgtccacacaatttctgctccgactctgcggactactgcagtggagcttgactcttaatgggtcccaaagcaaaaaaggaacactgtcatcacaaacaggcttcagtggccaaagatctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 113885 - DNA, 2146 bp, Homo sapiens
  Payload ID: 2237
  Gene Symbol: CASC1
  Gene Name: cancer susceptibility candidate 1
  Uniprot ID: Q6TDU7
  ENST ID: ENST00000545133
  CDS Start-End: 49-2022
aatttctgctccgactctgcggactactgcagtggagcttgactcttaatggatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatc

SEQ ID NO: 113886 - DNA, 2208 bp, Homo sapiens
  Payload ID: 2237
  Gene Symbol: CASC1
  Gene Name: cancer susceptibility candidate 1
  ENST ID: ENST00000554533
  CDS Start-End: 85-192
ctgtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaaggatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaacaagctagtactttggcagatctggacagtggaaatatggaaaaagtcattaaagatgaaaatgttactctgtatgtgtgggcaaacctcaagaagaatccaaggcacagaagtgttagattctctgaaacacaaattggatttgagattccaaggatattagcaacaagtgacattgctgtacgactcctgcatacccactatgatcatgtttctgcactgcaccctgtttcaacaccatcaaaagaatacacttctgcagtaactgagcttgtcaaagatgatgttaagaatgtagaaaaagcaatcagcaaggaggtcgaagaagagtccaaacaacaagaaagagggtctcacttaattcaggaggaagaaataaaagttgaggaggaacaaggtgatattgaagtgaaaatgagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgc

SEQ ID NO: 113887 - DNA, 563 bp, Homo sapiens
  Payload ID: 2237
  Gene Symbol: CASC1
  Gene Name: cancer susceptibility candidate 1
  ENST ID: ENST00000556467
  CDS Start-End: 83-220
gtcgtccgggcaacccgggagcgtttgtccacacaatttctgctccgactctgcggactactgcagtggagcttgactcttaatgtctggcagtaagaaaaagaaagtcaccaaagctgaacgattgaagctgctacaagaggaggaggagagacgactgaaagaggaagttactgtcttgaagaaaggagaactgacacttttctcatatctaccataggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaat

SEQ ID NO: 113888 - DNA, 583 bp, Homo sapiens
  Payload ID: 2237
  Gene Symbol: CASC1
  Gene Name: cancer susceptibility candidate 1
  ENST ID: ENST00000554347
  CDS Start-End: 306-583
acacaatttctgctccgactctgcggactactgcagtggagcttgactcttaatgagtttcgctctgttgcccaggctggaatgcaatggcgcgatctcggcttactgaaacctctgcctcccgggttcaagcgattctccttcaagcgattctcctgcctcagcctcccgagtagctgggattacagtctggcagtaagaaaaagaaagtcaccaaagctgaacgattgaagctgctacaagaggaggaggagagacgactgaaagaggaagaggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattga

SEQ ID NO: 113889 - DNA, 1774 bp, Homo sapiens
  Payload ID: 2237
  Gene Symbol: CASC1
  Gene Name: cancer susceptibility candidate 1
  ENST ID: ENST00000556006
  CDS Start-End: 1-1646
aggaagcccgtttgaaatatgagaaagaagaaatggaaaggcttgaaatacagcgaattgagaaagaaaaatggcatcgacttgaagcaaaagatctagaaaggagaaatgaagaacttgaagaactttatttattagagaggtgttttcctgaagcagagaaattgaaacaggaaactaaattgctttctcagtggaagcactacattcaatgtgatgggagtcctgatccttcagtagcccaagaaatgaacacgtttattagtttgtggaaagagaaaacaaatgagacttttgaggaagtgattgagaagagtaaagtagtgctaaatttaattgagaaattgaaatttattttactggaaactccaccatgtgatttgcaagataaaaatataatacagtaccaagaatcaatactacaactgcaggagctccttcatcttaaattcggtgtagccacagaaatacttctcaaaagttctgctgaggaagaatctgaagccataaaatgtgaacgagagatgaaagtattaagtgaaactgtttcagcagcacagttgttgctggtagagaattcttctgaaaagccagatttctttgaagacaatgtggtggatttatgccagttcacaactctgggtggagtataccacttggatattttggagcttcctccacagtgtaaaccagtgaagggatggatgattgtggaaatactcaaagaaggattacagaaatacacatatcctccggaaactacagaagagtttgagacagaaaatgctttcccacctatagaggtcacacttgaggttcatgagaatgtaatcttttttgaggatcctgtggttgtaaggtgggatgctgaaggtaaacattggagaactgatggcatcagcaatgtatcctacaaaccaaaagaaagacttgtaacattcagcctggacacctttggccctgttaccttgattcaagatgctcatattaacatgccgtaccagtcatgggaactaagaccacttgatgtaaataaagtacttttaactgtgactacagtatttactgagattcaaatacaaattaaggaaaacctctgcatgttatcttcaatcaaactaaaagacaagaaacacatctctattttggaaggaacctggatgactcctattcctttcattattgctttgaaagaagctggactgaatatctttcctactagacactctcatttttatgttattataaacaataaggttcctttggtagaagtgaaagcttatcgacagatggccctactaagttctgcttttgcatttggttggagcaagtggaacctactatgtaattctacaaaagtcgtatttaaggtgagggaacaccttactgaagcatgtactgagaatcctaattgggcccttttaatgtttagtggtgacagagcacaaagactgaagatcaaggaagagagtgaggcattttctgaagcacttaaagaagaaactgagtttcattctactttatatcacatggtgaaggattttgcttctgaggaagcaatggagaaagtcaggagttccaactgtcagtttgtcaactctgtgtgccacatgctgctctctaccagattgctcagctactcctaacctccacttacaaactgtattgtaagtatgaagaaccaagcatggtgaaagacaggtatttctgcaacacaatgtaatgagtgaatgaatacatttcaaatcaactattaaaaattttctaatctgca

SEQ ID NO: 113890 - DNA, 3801 bp, Homo sapiens
  Payload ID: 2238
  Gene Symbol: CASC10
  Gene Name: cancer susceptibility candidate 10
  Uniprot ID: Q5T4H9
  ENST ID: ENST00000377113
  CDS Start-End: 449-859
ccattgaggaccagggtcgcgccgagaggccggagggggctccaggcagcctggagctgacggcgccgggctgcgtcctcttcacctgggggtggggggtgggggcacgtactttgtgaccaggatggtgccgagccccctctacggcgggagcttgcaggggtgcgggggtgtgactggcgctccgcggactcgtgtccacagtacagaggacatgtagggttcggccggggcgcggctgcaccggggcctgcctcgcggacctggactcgggactccgggcggccctgcctggtgccattgcctcagccaagtctcccacctctctgctcggtttcccgccccacctttcccctactaccgcatccctgtcccctcgcttccctccgcgatgtctccatccgagtaagaaacgaagctgaacgcattggtaactgtgctcaagaagatgcaatcgcgggagccctcagggtggcgcacggcggagaggcgacgcgggtggcgctgcagaggcgtccccaccccctccggggaccggggccccggagctgccaggcccgctgcacgcggcggcgcgggagaaaccacggggcagcagcgccccctgcaggtgccgggcgcctccgcagccgctgcgcggacccgactcttaaggtggcaccaccgggttcccagcccgcgcgcaacccgcagccctggctccatccgccgcacttctccctgtagcggcgggcctgaccgtccggaacggccggagtgtgctgatgcctgctgctatctgcttgatcccttcaccctacctctcatccaggacttcttccgcggatgcgcagctagcgatttcgacaggcgagattgaaaattccgggcgagtatatgaggttgagtaagtcccgcttcagggaggaacgaccagaatgacatttctttaagcctaaatcaaacttttattttcgtttataaaaagcagaaggccagcaggaaagggtcgcggaggactggcacatccacaaccgtaggactcttggatccaagtttttaggctgagactgggcggtccggggttctccttcggcgctcacaccccgcaaactcgtgggcagtgcagtgctggaggccgggggcagtggcggacccgcagggtaaccttgtctcgcgcacctcccgagcccccagcagcccactctcgtccgaatgctttgtttatttggtgacaccagggaacgtggagaagaagatcgaagttcagtttttcttttttctttattttaaatatttttcttaactaaatggtatgtttatgtgaacccatcatctcttggaattaagtgtcctcagcgaactccagattcctaggggaaacctacgtgcccagagcaggaaacgcacaagtcaattcaggttccggtgccatccgcagtaaattcccttccttttgctccaaattcctcctctgcgtccaggagagggacccccgggactcccgcacacccaggaccgggagcggcagagcagagggcgggtgcgagggcgcgagggaagggaggcggcctgcggacctggggcgcgcagtttcccggctccgtgggaacctccaaccccggggcgcgcggcctaggctccgccctgccaggcttggggccgagcggcccacctagtgggtcctgacctggggaagccgagtccgcgcgcgggtcgggccgcgacgagggaagctcgcctgggcaagtgccgcgcggggtcagacccaccccaggggttgcaaaccgcaagcgaaagtcgagaggggctggagctttccctctgatccgttttacactgtgaaaaccgcaggcctgtcgcctaggcggccacttttaaattgggaagcaaatagacgaaaaaccaaaacaaacgtacgagctgacttttcccagctaagtttcccctcaataaaaagcccgctttctgggaaagacagaaactgatccgcgctcacgattgctttcttggagattctgggggcactggggcgcgcaggaggcgcggcgacaaccccagcgcgcatggggcagcctggactgtgcccctcttaccaagctccttcccaggcttctccgtgcttctctctccactggggtcccgcctctccacgggtcacgccgaggctatatgctgcttgcaaggggtccgcgctttctcgttcggcgggaaaggcacatgttggagctcgatgttggggctcagggtgtggttgatttgtctgctgatctgggtttcttcccagcaccgggcaggaagtgtaggagtttgggtcgccagtccagggactcgggaaacttccaggccaaccagaagaaacacttgcagacacctttcgaatgtcacagttttccccaggggaaaaagcagaagttgctgggcacatcacccagcacccgggcaaactctccacttacctcgcgccctgctagggggtgttgggggccctccgggaacccctagatgagcaagcaaagttgcaagaagtggggtggggaacgctcacccgataaaccatgcaccaaacttaatcagcctgtaatgcttactctaaatctaggcccatctaggccaggtgggctgagtcttgggatagtgggtgtctccttcctatgttgatacattaaggattccatatggacaattatttttagtcaaatttgtggtcctggagatagaaagaggagaagaagagagaagaaagacagaagagctttattgttcttttttttttttttttttttttgagatggagtctcgccctgttgtccaggctggagtacagtggcgccatcttggctaactgcaacctccacctccccggttcaagcaattctcctacctcagcctcctgagtagctgggactacaggcagccgccaccatgaccagctaatttttttttttacttttagtagagatggggtttcaccatgttagccaggatggtctcgaactcctgaccttgtgatccgcccacctcagcctccctaggtgctgggattacaggcgtgagcaaccacccggccttattgttcttatattaaaacaaaagaacctagaaaaaattgcttggttaaattgtagagaggaagggagggaaggaaaatgaaggcttttcttctttgttctttaaaagtccaagcactttctttcagaatcaaaatgtagagaggcagtcagtcttggagcatgcttttgcattttaggatactactcattaattcagttttaaagcattcactgggttgagcacaattttaaaaaggttctgactcacccagatcctgtttgaagctcaactcattttgattgaaagagatttgagacaagaatttcagaagagaaaaatgtgtgttacacctggacatatatacacatgtaacagggattgtattccttctagtctaagacaagagattctatggtaaattatttaaaaaaattagttttttttctagcattgtattgtcaccagaaagaagagtgctgaattctctgtttctgcatttcccaataataaatctcctaggagagataactttttgcagttgtgccccccacccattttctctgtggcttgctttatttcccacatatgaatacacacacagcagatacatcatgcacaaactttttttaatgtgtaatctgtaaatctaggcccattaagttttcattgaagttgggaaactgttgaggacttacttttgttcttcaccatgcgtgcactttgccaaggatctttggtaaccaataaaacgatcatgttcactctgaa

SEQ ID NO: 113891 - DNA, 4116 bp, Homo sapiens
  Payload ID: 2239
  Gene Symbol: CASC3
  Gene Name: cancer susceptibility candidate 3
  Uniprot ID: O15234
  ENST ID: ENST00000264645
  CDS Start-End: 227-2338
cacacacacacacacacacacacacaccccaacacacacacacacaccccaacacacacacacacacacacacacacacacacacacacacacacacacacacacacagcgggatggccgagcgccgcacgcgtagcacgccgggactagctatccagcctcccagcagcctctgcgacgggcgcggtgcgtaagtacctcgccggtggtggccgttctccgtaagatggcggaccggcggcggcagcgcgcttcgcaagacaccgaggacgaggaatctggtgcttcgggctccgacagcggcggctccccgttgcggggaggcgggagctgcagcggtagcgccggaggcggcggcagcggctctctgccttcacagcgcggaggccgaaccggggcccttcatctgcggcgggtggagagcgggggcgccaagagtgctgaggagtcggagtgtgagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggtaccggccgtatgtctgcacccaggaattattctcgatctgggggcttcaaggaaggtcgtgctggttttaggcctgtggaagctggtgggcagcatggtggccggtctggtgagactgttaagcatgagattagttaccggtcacggcgcctagagcagacttctgtgagggatccatctccagaagcagatgctccagtgcttggcagtcctgagaaggaagaggcagcctcagagccaccagctgctgctcctgatgctgcaccaccaccccctgataggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatcccccaccagtgtccatgtctccaggacagccaccacctcagcagttgcttgctcctacttacttttctgctccaggcgtcatgaactttggtaatcccagttacccttatgctccaggggcactgcctcccccaccaccgcctcatctgtatcctaatacacaggccccatcacaggtatatggaggagtgacctactataaccccgcccagcagcaggtgcagccaaagccctccccaccccggaggactccccagccagtcaccatcaagccccctccacctgaggttgtaagcaggggttccagttaatacaagtttctgaatattttaaatcttaacatcatataaaaagcagcagaggtgagaactcagaagagaaatacagctggctatctactaccagaagggcttcaaagatatagggtgtggctcctaccagcaaacagctgaaagaggaggacccctgccttcctctgaggacaggctctagagagagggagaaacaagtggacctcgtcccatcttcactcttcacttgagttggctgtgttcgggggagcagagagagccagacagccccaagcttctgagtctagatacagaagcccatgtcttctgctgttcttcacttctgggaaattgaagtgtcttctgttcccaaggaagctccttcctgtttgttttgttttctaagatgttcatttttaaagcctggcttcttatccttaatattattttaattttttctctttgtttctgtttcttgctctctctccctgcctttaaatgaaacaagtctagtcttctggttttctagcccctctggattcccttttgactcttccgtgcatcccagataatggagaatgtatcagccagccttccccaccaagtctaaaaagacctggcctttcacttttagttggcatttgttatcctcttgtatacttgtattcccttaactctaaccctgtggaagcatggctgtctgcacagagggtcccattgtgcagaaaagctcagagtaggtgggtaggagcccttctctttgacttaggtttttaggagtctgagcatccatcaatacctgtactatgatgggcttctgttctctgctgagggccaataccctactgtggggagagatggcacaccagatgcttttgtgagaaagggatggtggagtgagagcctttgcctttaggggtgtgtattcacatagtcctcagggctcagtcttttgaggtaagtggaattagagggccttgcttctcttctttccattcttcttgctacaccccttttccagttgctgtggaccaatgcatctctttaaaggcaaatattatccagcaagcagtctaccctgtcctttgcaattgctcttctccacgtctttcctgctacaagtgttttagatgttactaccttattttccccgaattctatttttgtccttgcagacagaatataaaaactcctgggcttaaggcctaaggaagccagtcaccttctgggcaagggctcctatctttcctccctatccatggcactaaaccacttctctgctgcctctgtggaagagattcctattactgcagtacatacgtctgccaggggtaacctggccactgtccctgtccttctacagaacctgagggcaaagatggtggctgtgtctctccccggtaatgtcactgtttttattccttccatctagcagctggcctaatcactctgagtcacaggtgtgggatggagagtggggagaggcacttaatctgtaacccccaaggaggaaataactaagagattcttctaggggtagctggtggttgtgccttttgtaggctgttccctttgccttaaacctgaagatgtctcctcaagcctgtgggcagcatgcccagattcccagaccttaagacactgtgagagttgtctctgttggtccactgtgtttagttgcaaggatttttccatgtgtggtggtgttttttgttactgttttaaagggtgcccatttgtgatcagcattgtgacttggagataataaaatttagactataaacttggctcccttgcca

SEQ ID NO: 113892 - DNA, 908 bp, Homo sapiens
  Payload ID: 2239
  Gene Symbol: CASC3
  Gene Name: cancer susceptibility candidate 3
  ENST ID: ENST00000474190
  CDS Start-End: 1-670
gctgaaatcagaagctaatgatgctgttaattcttcaacaaaagaagagaagggagaagaaaagcctgacaccaaaagcactgtgactggagagaggcaaagtggggacggacaggagagcacagagcctgtggagaacaaagtgggtaaaaagggccctaagcatttggatgatgatgaagatcggaagaatccagcatacatacctcggaaagggctcttctttgagcatgatcttcgagggcaaactcaggaggaggaagtcagacccaaggggcgtcagcgaaagctatggaaggatgagggtcgctgggagcatgacaagttccgggaagatgagcaggccccaaagtcccgacaggagctcattgctctttatggttatgacattcgctcagctcataatcctgatgacatcaaacctcgaagaatccggaaaccccgatatgggagtcctccacaaagagatccaaactggaacggtgagcggctaaacaagtctcatcgccaccagggtcttgggggcaccctaccaccaaggacatttattaacaggaatgctgcaggcccattgagaagaaatcctattcccgggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaaga

SEQ ID NO: 113893 - DNA, 714 bp, Homo sapiens
  Payload ID: 2239
  Gene Symbol: CASC3
  Gene Name: cancer susceptibility candidate 3
  ENST ID: ENST00000577605
  CDS Start-End: 1-389
gggcaagaagaactcgaaccaaagttggagatgcagtcaagcttgcagaggaggtgccccctcctcctgaaggactgattccagcacctccagtcccagaaaccaccccaactccacctactaagactgggacctgggaagctccggtggattctagtacaagtggacttgagcaagatgtggcacaactaaatatagcagaacagaattggagtccggggcagccttctttcctgcaaccacgggaacttcgaggtatgcccaaccatatacacatgggagcaggacctccacctcagtttaaccggatggaagaaatgctcactttgcaaatatccattaaatacctgccatgtaccaagtgtttttcaacacctaaaggaaggtaggacttgatatgagagccctctagaattcttattgtttaggcctctttctttgtctcagggtgtccagggtggtcgagccaaacgctattcatcccagcggcaaagacctgtgccagagccccccgcccctccagtgcatatcagtatcatggagggacattactatgatccactgcagttccagggaccaatctatacccatggtgacagccctgccccgctgcctccacagggcatgcttgtgcagccaggaatgaaccttccccacccaggtttacatccccaccagacaccagctcctctgcccaatccaggcctctatccc

SEQ ID NO: 113894 - DNA, 543 bp, Homo sapiens
  Payload ID: 2239
  Gene Symbol: CASC3
  Gene Name: cancer susceptibility candidate 3
  ENST ID: ENST00000584997
  CDS Start-End: 345-543
aggtgatgctaggtagtctgtgagttgatagtagatactgggacttttttttgtttttgagagaaaaggggagttatcccaatgcgagtttgcatccggagttccaagggaagaagaaggattgggggtttctgggaggatggtagagccgctggagatggaaagcggatgttttattcagaagtcggggctggagggaaggagaccagacctgccttggctactacttgataaagatttacctatctctgtctccctctccaaccattttgtgctgaatcttcagcttttcacccacatttctttattgggctccccacctctggaaatcacagaactaacccatgtcttctgctttctttcaggagagtgaagatggcattgaaggtgatgctgttctctcggattatgaaagtgcagaagactcggaaggtgaagaaggtgaatacagtgaagaggaaaactccaaagtggagctgaaatcagaagctaatgatgctgttaattcttcaacaaaagaagagaagggagaagaaaagcctg

SEQ ID NO: 113895 - DNA, 3962 bp, Homo sapiens
  Payload ID: 2240
  Gene Symbol: CASC4
  Gene Name: cancer susceptibility candidate 4
  Uniprot ID: Q6P4E1
  ENST ID: ENST00000299957
  CDS Start-End: 300-1610
ccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaagccgattctttgatgaaaatgaatcccctgttgatccgcagcatggctctaaactggcggattataatggggatgatggtaacgtaggtgagtatgaggcagacaagcaggctgagctggcttacaatgaggaagaagatggtgatggtggagaggaagacgtccaagatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttgt

SEQ ID NO: 113896 - DNA, 3764 bp, Homo sapiens
  Payload ID: 2240
  Gene Symbol: CASC4
  Gene Name: cancer susceptibility candidate 4
  Uniprot ID: Q6P4E1
  ENST ID: ENST00000345795
  CDS Start-End: 271-1413
gcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctgctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaactttaatgaaggaatgtacccatgtacatatgtgaactttttcatattgtattatcaaggtatagacttttttggttatgatacagttaagccaaaaacagctaatctttgcatctaaagcaaactaatgtatatttcacattttattgagccgacttatttccacaaatagataaacaggacaaaatagttgtacaggttatatgtggcatagcataaccacagtaagaacagaacagatattcagcagaaaactttttatactctaattctttttttttttttttttgagacagagttttagtcttgtttcccaggctggagtgcaatggcacaatcttggctcactgcaacctccgcctcctgggttcaggcaattttcctgcctcagcctcccaagtagctgggattacaggcacccaccaccatgcccagctaatttttgtatttttaatagagagctaataattgtatatttaataaagacgggtttcaccatgttggccaggctggtcttgaactcctgacctcaggtgatcctcctgcattggcctcccaaagtgctggaattccaggcatgagccactgcgcccagtctacacactaattcttgttagcccaacagctgttctgttctatctacccctcatttcacgctcaaggagtcatacctagaatagttacacacaagagggaaactggaagccaaacactgtacagtattgtgtagaaagtcacctccctactccttttattttacatgagtgctgatgtgttttggcagatgagctttcagctgaggcctgatggaaattgagataacctgcaaagacataacagtatttatgagttatatcttagttcttgaaattgtggaatgcatgattgacaatatatttttaatttttattttttcaagtaataccagtactgtttaactatagccagaactggctaaaatttttatattttcagagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaatgaatctttgtaattacttaatatgttagttaagaacccgtcaagcttatatttgctagacttacaaattattttaaatgcatttatcttttttgacactattcagtggaatgtgtaagctagctaattcttgttttctgatttaaagcacttttaaatcttatcctgccccctaaaaacaaaaggttttgatcacaaggggaaatttaagattgttaaccctgtttttcagaagggctactgttaattgcacataaacatgaaatgtgttttcccctgtgtactaacacattctaggcaaaattcaaacttatagtggtaaagaaacaggttgttcacttgctgaggtgcaaaaattcttaagacttctgtttgaaattgctcaatgactaggaaaagatgtagtagtttactaaaattgtttttctaccatatcaaattaaacaattcatgcctttatagggtcaggcctacaatgaataggtatggtggtttcacagaattttaaaatagagttaaagggaagtgatgtacatttcgggggcattagggtagggagatgaatcaaaaaatacccctagtaatgctttatattttaatactgcaaaagctttacaaatggaaaccatgcaattacctgccttagttcttttgtcataaaaacaatcacttggttggttgtattgtagctattacttatacagcaacatttcttcaattagcagtctagacattttataaacagaaatcttggaccaattgataatatttctgactgtattaatattttagtgctataaaatactatgtgaatctcttaaaaatctgacattttacagtctgtattagacatactgtttttataatgttttacttctgccttaagatttaggttttttaaatgtatttttgccctgaattaagtgttaatttgatggaaactctgcttttaaaatcatcatttactgggttctaataaattaaaaattaaacttg

SEQ ID NO: 113897 - DNA, 353 bp, Homo sapiens
  Payload ID: 2240
  Gene Symbol: CASC4
  Gene Name: cancer susceptibility candidate 4
  ENST ID: ENST00000561305
  CDS Start-End: 1-75
caagatgatgaagaacgagagcttcaaatggatcctgcagactatggaaagcaacatttcaatgatgtcctttaagtcctaaaggaatgcttcagaaaacctaaaagttgaagttggtgaagacattcatgatttaaacaccagatcctgaaaggggttaaatctactttgaaatgaatctgcaatcagtatttcaaagcttttctggtaattttagtgatcttatttgattagactttttcagaagtactaaataaggaattttaacaggtttttattaatgcacagataaatagaagtacagtgaggtctatagccattttattaaaatagcttaaaagtttgtaaaaaaa

SEQ ID NO: 113898 - DNA, 622 bp, Homo sapiens
  Payload ID: 2240
  Gene Symbol: CASC4
  Gene Name: cancer susceptibility candidate 4
  ENST ID: ENST00000558847
  CDS Start-End: 1-485
aagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagctttaaggaagcctcctatttcagtttctcaacatgaaagtcatcaagcaatctcccatcttccaactggacaacctctctccccaaatatgcctccagattcacacataaaccacaatggaaaccccggtacttcaaaacagaatccttccagtcctcttcagcgtttaattccaggctcaaacttggacagtgaacccagaattcaaacagatatactaaagcaggctaccaaggacagagtcagtgatttccataaattgaagcaaaatgatgaagaacgagagcttcaaatggatcctgcagactatggaaagcaacatttcaatgatgtcctttaagtcctaaaggaatgcttcagaaaacctaaagtgctgtaaaatgaaatcattctactttgtcctttctgacttttgttgtaaagacgaattgtatcagttgtaaagatacattgagatagaattaaggaaaaacttta

SEQ ID NO: 113899 - DNA, 742 bp, Homo sapiens
  Payload ID: 2240
  Gene Symbol: CASC4
  Gene Name: cancer susceptibility candidate 4
  ENST ID: ENST00000559222
  CDS Start-End: 405-742
aaccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagaccagtttttagaggaacaaaagcaagagacccaaaagattcaatcaaatgatggaaaggaattggatataaacaatcaagtagtacctaaaaatattccaaaagtagctgagaatgttgcagataagaatgaagaaccctc

SEQ ID NO: 113900 - DNA, 1386 bp, Homo sapiens
  Payload ID: 2240
  Gene Symbol: CASC4
  Gene Name: cancer susceptibility candidate 4
  Uniprot ID: Q6P4E1
  ENST ID: ENST00000557945
  CDS Start-End: 300-833
ccgtgaggtgttgggtttgggggacgctggcagctgggttctcccggttcccttgggcaggtgcagggtcgggttcaaagcctccggaacgcgttttggcctgatttgaggaggggggcggggagggacctgcggcttgcggccccgcccccttctccggctcgcagccgaccggtaagcccgcctcctccctcggccggccctggggccgtgtccgccgggcaactccagccgaggcctgggcttctgcctgcaggtgtctgcggcgaggcccctagggtacagcccgatttggccccatggtgggtttcggggccaaccggcgggctggccgcctgccctctctcgtgctggtggtgctgctggtggtgatcgtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaaggttaaactacagaacaacatatcgtatcagatggcagacatacatcatttaaaggagcaacttgctgagcttcgtcaggaatttcttcgacaagaagaccagcttcaggactataggaagaacaatacttaccttgtgaagaggttagaatatgaaagcaagagacccaaaagattcaatcaaatgatggaaaggaattggatataaacaatcaagtagtacctaaaaatattccaaaagtagctgagaatgttgcagataagaatgaagaaccctcaagcaatcatattccacatgggaaagaacaaatcaaaagaggtggtgatgcagggatgcctggaatagaagagaatgacctagcaaaagttgatgatcttccccctggccctggttcccagacatcatctctgaacctgctgggggaatttgccaccctgaaaggaaggacacaagcccagctggcttcatcatctgctgattgtggagctctagggccttgagcaaacatatgtggtagccaggtagtggttacagcaggccttggtaagacccagtgctgtattggcttcaggtctaacccagcacagttctaatggtggtgccacagtggtacatgcctatagtcccagctactccagaagctgaggtgggaagatcacttgagcctgggagattgaggctgcagtgagctgagatcatgccattgcactccagcttgggcaccagagcaagaccttgtctcaaaaaaagaaaaaaaaaa

SEQ ID NO: 113901 - DNA, 427 bp, Homo sapiens
  Payload ID: 2240
  Gene Symbol: CASC4
  Gene Name: cancer susceptibility candidate 4
  ENST ID: ENST00000558735
  CDS Start-End: 1-248
gtcgtcctcgccttcaactactggagcatctcctcccgccacgtcctgcttcaggaggaggtggccgagctgcagggccaggtccagcgcaccgaagtggcccgcgggcggctggaaaagcgcaattcggacctcttgctgttggtggacacgcacaagaaacagatcgaccagaaggaggccgactacggccgcctcagcagccggctgcaggccagagagggcctcgggaagagatgcgaggatgacaagagcaacttgctgagcttcgtcaggaatttcttcgacaagaagaccagcttcaggactataggaagaacaatacttaccttgtgaagaggttagaatatgaaagttttcagtgtggacagcagatgaaggaattgagagcacagcatgaagaaaatattaaaaagttagcagacca

SEQ ID NO: 113902 - DNA, 9573 bp, Homo sapiens
  Payload ID: 2241
  Gene Symbol: CASC5
  Gene Name: cancer susceptibility candidate 5
  Uniprot ID: Q8NG31
  ENST ID: ENST00000346991
  CDS Start-End: 391-7419
aagcaatcgaaagaagatggccgctcccacgattgtgggggaggtctccactggggaggggcagaggaaattcggtcgaaaaagagataaagctgaaggaaataaaattggcacggagtctgggaaagtagtttccctaaaggagtcttagaaatagggttggtctggaacctaaggggcggagccgacgcgtagagccgctttgcgcgtgcgcatcacctaggcggttagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaaggctgcagtgcaatggtgccatctcagctgcaacttctgcctcctgggtttaagcgattctcctgcctcagcctcccagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgggtgcggtggctcacacctgtaataccagcagtttgggaggccaaaatgggtgaatagcctgagtccaggaattcaagaccagcctgggcaacatggcaaaaccccacctctacaaaaaatacgaaagttagccagtcatggtggcttgcgcctgtggtcccagctacttaggagcttaaggcaggaggatcacttgagcccaggaggcagaggttgcagtaagccgagaccattccactgcactccagcctaggcaacagagcaagaccctgtctcaaaaaaacaaaaagagagaaagcaatagcactcagctattgaaatggttgccatctttttttgaaggccttgctttttattctatggtgtctattatgttttctttttctttttttttgagacggagtcttgctctgtcgcccaggctggagtgcagtggcatgatctcagctcactgcaagctccgcctcctgggttcacgccattctcctgcctcagcctcccgagtagctgggactacaggtgcccaccaccatgccgggctaattttttgtctttttagtagaaatggggtttcacgatgttagccaggatggtctcgatctcctgacctcgtgatccgcctgcctcggcttcaaagtgctgggattacaggtgtgagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattactttaaa

SEQ ID NO: 113903 - DNA, 7607 bp, Homo sapiens
  Payload ID: 2241
  Gene Symbol: CASC5
  Gene Name: cancer susceptibility candidate 5
  Uniprot ID: Q8NG31
  ENST ID: ENST00000399668
  CDS Start-End: 162-7112
agatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgg

SEQ ID NO: 113904 - DNA, 5584 bp, Homo sapiens
  Payload ID: 2241
  Gene Symbol: CASC5
  Gene Name: cancer susceptibility candidate 5
  ENST ID: ENST00000526913
  CDS Start-End: 1-4084
gtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaaggccttgattgagacataccaaaaagagatttcaccatatgaaaataaaatgggaaaaacttgcaatagccaaaaaagaacgtgggtacaagaagaagaagatattcataaggagaaaaaaatcagaaaaaatgagattaagtttagtgatacgacacaagatcgggagatttttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagaaactccaagatgggagaataacaataagggagttctttatacttctccaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatacttaagaagatcgataactgcctcactgagatggaaacagaaactaagaatttggaggatgaagagaaaaacaatcctgtggaagaatgggattctgaaatgagagctgcagaaaaagaattggaacagctgaaaactgaagaagaggagcttcaaagaaatctcttagaactggaggtacaaaaagagcagacccttgctcaaatagactttatgcaaaaacaaagaaatagaactgaagagctactggatcagttgagcttgtctgagtgggatgtcgttgagtggagtgatgatcaagctgtattcacctttgtttatgacacgatacaactcaccatcacctttgaagagtcagttgttggtttccctttcctggacaagcgttataggaagattgttgatgtcaattttcaatctctgttagatgaggatcaagctcctccttcctcccttttagttcataagcttattttccagtacgttgaagaaaaggaatcctggaagaagacatgtacaacccagcatcagttacccaagatgcttgaagaattctcactggtagtgcaccattgcagactccttggagaggagattgagtatttaaagagatggggaccaaattataacctaatgaacatagatattaataataatgaattgagacttttattctctagctccgcagcatttgcaaagtttgaaataactttgtttctctcagcctattatccatctgtaccattaccttccaccattcagaatcacgttgggaacactagccaagatgatattgctaccattctatctaaagtgccactggagaacaactacctgaagaatgtagtcaagcaaatttaccaagatctgtttcaggactgccatttctaccactagacccttggaccaccattggaacaaccaagcagaatgtacttgatattatttcagggtcccattgctgttcagcctttgtttttacgtcattacaagctgagtaaaattccttctgatgatgttatagttaatctgtatgttttttatatctctgcagaatgatggtgatgaagtctggatggtaggcctcatagcctactatcaacttactcatctttgtaccaaaggtttaagtaataggacacttaggaaaaatgtctcctaactaaactagtgctttctgctttagtacaagccctaaggattaacttaagtataagaagtgttatcactgacaagaacattagccattttcccataactagatagagctatgattttttaggttgcctggcttctgcctagcagatatttctggagtagaaatgtatctgtctacaaactattatcctttttctccgttactaaaatgctattaagagaaagtagggctgggtgtgagccaccacacccagcaatgttttcttaataagtatagtttttctagggaaagttaattcatttttgtctagtacatatatgtaaatatattaatgttgtttttgtgtttgtgatgtagtaaggagatgtacatagaaattcattgaggtatatagatactcatctgtctaggcagttcccaattttctgaagaatgttttacagcaaaattttctattttcttttattaaatagtgacacgtcaaacaatgtcacatccaaaacactagtttcatcaatttctagcagtaataatagacttgctgtaagtattgttttctgatgccatacccttgtcatacatattattaaatgaccaatattatgtatgaagtagacaaaaaaatttactcaaacttcattcaaatcctaattgtgataatttttgttttatatttaattataaaccaaaatacatttgcatttttaagctaatttgtctcaaaattttgctttatatttttggatcaggttaaagtcctgtggatcccctgaatgttattgtccctcttgattggtttttacttctgagctatacgtcaaaagacacataagcttcaaaagtcaagacaaacctcatttgccataaaaatcaagatatagatgttctgttccgtaaactccttgaaaaacattttaaagtcatcaatatgatctgtttcccatgaaacttaagttagctttcttattggagttatttcttttctgtaagtctgaaaagtagagattttgttttacgcattttagtaacctgcaacaaccaactctaaaaaagatttggcttgtaatgacggtctctgcttttttgggtttggagtacacaattgtaatatttacttagttatttgtgtttttctttgttcaaggtattgactagtttcataaattttttgaaagtttttctttcattggttggaaagcagattacattttgcactattaaaataagtttattacttt

SEQ ID NO: 113905 - DNA, 5404 bp, Homo sapiens
  Payload ID: 2241
  Gene Symbol: CASC5
  Gene Name: cancer susceptibility candidate 5
  ENST ID: ENST00000527044
  CDS Start-End: 162-5402
agatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcagaaatggaagaaacagaaacaggagaaaatcttcttttgatacagaataagaaattagaagataattactgtgaaattactgggatgaacacattgctttctgctcccattcatacccagatgcaacagaaggagttttcaattatagaacatacccgtgaaaggaaacatgcaaatgaccagacagtcattttttcagatgaaaaccagatggacctgacatcaagtcacactgtaatgattaccaaaggccttttagataatcccataagtgaaaagtccaccaagatagataccacatcatttctagctaatttaaagcttcacaccgaggactcaagaatgaaaaaagaagtaaatttttccgtggatcaaaacacttcttcagaaaataaaatagatttcaatgacttcataaaaagattgaaaacaggaaaatgtagtgcttttcctgatgtgcctgataaagaaaattttgagatacctatttattccaaggaaccgaacagtgcctcttctacacatcaaatgcatgtatctcttaaggaagatgaaaataacagtaatattactaggctctttagagaaaaagatgatgggatgaatttcacccagtgtcatacagccaatattcagacattgattcccacatccagtgagaccaactcacgggaatctaaaggtaatgatattacaatttatggcaatgactttatggacttgacatttaaccacactttgcagatcttacctgcaacaggtaatttttctgaaatagaaaatcaaactcagaatgccatggatgtaacaacaggttatggaactaaagcttcaggaaataaaacagtttttaagagtaaacaaaatactgcttttcaagacctttccataaactctgcagacaaaatacatattaccagaagtcatattatgggggcagaaactcacatagtctcacagacttgtaatcaggatgccagaatattagccatgaccccagaatctatatattctaatccatctattcaaggttgtaagactgttttctattctagttgtaatgatgccatggaaatgaccaaatgtctctcaaatatgagagaggagaaaaatttgctaaagcatgacagtaattatgctaaaatgtattgcaatccagatgctatgtcttctctcacagagaaaactatttattccggagaggagaacatggacattaccaagagtcatacagttgcaatagataatcaaatttttaaacaagatcaatcaaatgtgcaaatagcagctgcaccaacacccgaaaaagaaatgatgctccaaaatcttatgaccacatcagaagatgggaaaatgaatgtaaattgtaactcagttcctcatgtatctaaggaaagaatacagcagagcctgtcaaatcctttgtctatttcattgactgatagaaagactgaactcttatcaggtgaaaatatggatttgactgaaagtcacacaagtaacttaggaagtcaggttcctcttgcagcttataatctagcaccggagagtaccagtgaatctcactctcagagcaaaagctcttcagatgaatgtgaagaaattaccaaaagtcgtaatgaaccatttcagcgatcagacataatagccaaaaacagcttaaccgacacctggaacaaagacaaagattgggttttgaagattttgccctaccttgataaagattctcctcagtcagctgattgtaatcaggagatagcaacaagccataatatagtctactgtggtggagttcttgataaacaaataactaatagaaatacagtatcatgggaacaatctttgttttctaccacaaagccattattttcatcaggacagttctctatgaaaaatcatgatactgctataagtagtcatacagtgaaatctgtactaggccagaattctaaactggctgagccactgaggaaaagtttaagcaatcccacacctgactattgccatgacaagatgattatatgttcagaggaagagcaaaatatggatctaacaaagagccacactgtcgtcattggatttggtccttctgaactacaagaacttggtaaaactaatttagaacacactactggccagctaacaacaatgaacagacagatagctgtaaaagttgaaaaatgtggtaaaagtcccatagaaaaaagtggagtgcttaaatctaactgtattatggatgtgttagaggacgaaagtgtacagaaacctaaatttccaaaggaaaagcaaaatgtcaaaatttggggaaggaaaagtgttggtggaccaaaaattgataagactattgtattttcagaagacgataagaatgatatggatatcactaagagttatacaatagaaataaaccatagacctttattagagaaacgtgattgtcatttggtgccattggcaggaacttctgaaactattttatatacatgtaggcaggatgacatggagatcactagaagtcacacaactgccttagaatgtaaaactgtctcaccagatgaaataactactaggcctatggacaaaactgtagtgtttgtagataatcatgttgaactagaaatgacagagtcccatactgttttcattgactaccaagaaaaggaaagaacagacagacctaactttgaactatcccaaaggaaaagcctaggaacaccaacagtgatatgtactcctactgaggagagtgttttctttccaggaaatggtgaaagtgaccgtctagtagcaaatgacagccagctaacccctctggaggaatggtctaataataggggccctgtagaggtagctgataacatggaattgtctaaatcagccacttgcaaaaacatcaaagatgtacaaagtcctggatttctgaatgaacctctatcaagcaaaagtcagagaagaaaaagccttaagctaaaaaatgacaagaccattgtattttcagagaatcataaaaatgatatggatattacccagagttgtatggtggaaatagataacgaaagtgccctggaggataaagaggacttccatttggcaggggcttctaaaactattttgtattcatgtgggcaggatgacatggagatcactaggagtcacacaactgccttagaatgtaaaactctcctgccaaatgaaatagctattaggcccatggacaaaaccgtattgttcacagataattacagtgatctggaagtcaccgattcccatactgttttcattgactgtcaagccacagagaaaatacttgaagaaaaccctaaatttggaataggaaaaggaaaaaacttgggtgtttcctttcctaaggataatagctgtgttcaagaaatcgctgaaaaacaagcactggctgtaggaaacaaaatagttcttcacaccgagcaaaagcaacaactctttgctgctactaatagaactactaatgaaatcatcaaatttcatagtgctgctatggatgaaaaggtcatagggaaagttgtagaccaggcctgtacattggaaaaagcgcaagttgaaagctgtcagttaaataatagagatagaagaaatgtggactttacaagtagtcatgcaactgctgtttgtggatccagtgataattattcctgtttaccaaatgttatttcctgtactgataatttggagggtagtgccatgctcttatgtgataaagatgaggaaaaagccaattattgcccagtgcaaaatgatcttgcttatgcaaatgattttgccagtgaatattacttggaatctgagggacagcctctctctgctccttgtcctttgttagagaaggaagaagttattcaaaccagtaccaaaggacagttagactgtgttataacactgcacaaagatcaagatctgattaaggatccacgaaatctattggctaatcaaactttagtatatagtcaagatctgggggagatgactaaacttaattcaaagcgagtatcttttaagcttccaaaggatcaaatgaaagtctatgttgatgacatttatgttattcctcagcctcatttctcaaccgaccaacctccattacctaaaaaaggacagagtagtatcaataaagaagaagtaatactgtctaaagctggaaataagagtttaaatattatagaaaattcctctgcacccatatgtgaaaacaagcccaaaatactcaatagtgaggaatggtttgctgcagcctgtaaaaaagaactgaaggaaaatattcaaacaactaactataatacagctctagatttccacagtaactcagacgtaactaagcaagtcattcaaactcatgtcaatgctggagaagcaccagatcctgtaattacatctaatgttccatgttttcatagtatcaaaccaaatctgaataatttgaatggaaaaactggagagtttttagcctttcaaactgttcatctaccaccccttccagagcaattacttgaattaggaaataaggcacacaatgatatgcatatagtgcaagctacagaaatacataatattaacataatctccagcaatgctaaagatagtagagatgaggaaaataaaaagtctcataatggagctgaaaccacctctctaccgccaaagacagtttttaaagataaagtaaggagatgttctttgggaatctttttgcctagattgcccaacaagagaaattgtagtgtcactggtattgatgacctggaacagattccagcagacacaactgatataaatcacttagaaactcagccggtctctagcaaagattcaggcattggatctgttgcaggtaaactgaacctaagtccttctcaatatataaatgaggaaaatcttcctgtatatcctgatgagatcaattcttcagactctattaacatagaaactgaggaaaagaacgtgggtacaagaagaagaagatattcataagg

SEQ ID NO: 113906 - DNA, 579 bp, Homo sapiens
  Payload ID: 2241
  Gene Symbol: CASC5
  Gene Name: cancer susceptibility candidate 5
  ENST ID: ENST00000532406
  CDS Start-End: 1-579
ttgatcaccatactgaagaggatatagataaaagtgctaacagtgtattgataaaaaacctgagcaggaccccatctagttgcagcagctctctggattcaatcaaggctgatgggacctctctggacttcagcacttaccgcagtagtcaaatggaatcacagtttctcagagatactatttgtgaagagagcttgagggagtttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgactaaagtcttcactcaccaaggaaaagtggctctgtatggcaagctggtgcagtcagctcagaatgagagggagaaacttcaaataaagatagatgagatggataaaatactta

SEQ ID NO: 113907 - DNA, 565 bp, Homo sapiens
  Payload ID: 2241
  Gene Symbol: CASC5
  Gene Name: cancer susceptibility candidate 5
  ENST ID: ENST00000534204
  CDS Start-End: 139-381
gagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaatgacaatatagagagacctgttagaagacggcattcttcaatattgaaacccccaaggagtcctcttcaggacctcagaggtccacatcttgatacagaaaccccgacagagcaatctcccaggcaattttactgtaaacacaccacctactccagaagacctgatgttaagtcaatatgtttaccgacccaagatacagatttatagagaagattgtgaggctcgtcgccaaaagattgaagaattaaagctttctgcatcgaaccaagataagctgttggttgatataaataagaacctgtgggaaaaaatgagacactgctctgacaaagagctgaaggcctttggaatttatcttaacaaaataaagtcatgttttaccaagatgact

SEQ ID NO: 113908 - DNA, 259 bp, Homo sapiens
  Payload ID: 2241
  Gene Symbol: CASC5
  Gene Name: cancer susceptibility candidate 5
  ENST ID: ENST00000532056
  CDS Start-End: 229-259
agatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcaggaatccaatgctttgagaaataagaaaaactctcgtcgagtcagctttgcagatactataaaggtattccagacggagtctcatatgaaaatagtgagaaagtcagaaatggaag

SEQ ID NO: 113909 - DNA, 578 bp, Homo sapiens
  Payload ID: 2241
  Gene Symbol: CASC5
  Gene Name: cancer susceptibility candidate 5
  ENST ID: ENST00000528975
  CDS Start-End: 556-578
agatggccgctcccacgattgtgggggaggtctccactggggaggggcagaggaaattcggtcgaaaaagagataaagctgaaggaaataaaattggcacggagtctgggaaagtagtttccctaaaggagtcttagaaatagggttggtctggaacctaaggggcggagccgacgcgtagagccgctttgcgcgtgcgcatcacctaggcggttagatttgaatacttcactgaggcgagccgggcgttgtgagcggactgctagaggcggctgtctgtttccgctctaaggaaactcagagcgtgtggaccccaaacaagtctgcgcaaaatttgtcgaggaggtttgccgcggcagaaaagttttcttcaaaaatggatggggtgtcttcagaggctaatgaagaaaaatattgaaacccccaaggagtcctcttcaggacctcagaggtgggaatgaaagagttcaggaatccaatgctttgagaaataagaaaaactctcgtcgagtcagctttgcagatactataaaggtattccagacggagtctcatatgaaaatagtgagaaagtcaga

SEQ ID NO: 113910 - DNA, 748 bp, Homo sapiens
  Payload ID: 2242
  Gene Symbol: CTAG1A
  Gene Name: cancer/testis antigen 1A
  Uniprot ID: P78358
  ENST ID: ENST00000599837
  CDS Start-End: 54-596
atcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacga

SEQ ID NO: 113911 - DNA, 993 bp, Homo sapiens
  Payload ID: 2242
  Gene Symbol: CTAG1A
  Gene Name: cancer/testis antigen 1A
  ENST ID: ENST00000593606
  CDS Start-End: 65-697
tctgcctccgcatcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatgtcagttcaggaccaggacagggatggggccgggtggcggagcgtggcagggtgggggctgggatccgcctacccccacggtcaggctgctagaaacctgggaacaccccagcacagggtctcagaacagagacctggtacaccaggcccgccgccacccgagggagcccagggagatgggtgcagaggtgtcgcctttaacgtgatgttctctgcccctcacatttagccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacgattccg

SEQ ID NO: 113912 - DNA, 748 bp, Homo sapiens; identical to SEQ ID NO: 113910
  Payload ID: 2243
  Gene Symbol: CTAG1B
  Gene Name: cancer/testis antigen 1B
  Uniprot ID: P78358
  ENST ID: ENST00000328435
  CDS Start-End: 54-596

SEQ ID NO: 113913 - DNA, 998 bp, Homo sapiens
  Payload ID: 2243
  Gene Symbol: CTAG1B
  Gene Name: cancer/testis antigen 1B
  Uniprot ID: P78358
  ENST ID: ENST00000359887
  CDS Start-End: 65-571
tctgcctccgcatcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgggaggaggcgccccgcggggtccgcatggcggcgcggcttcagggctgaatggatgctgcagatgcggggccagggggccggagagccgcctgcttgagttctacctcgccatgcctttcgcgacacccatggaagcagagctggcccgcaggagcctggcccaggatgccccaccgcttcccgtgccaggggtgcttctgaaggagttcactgtgtccggcaacatactgactatgtcagttcaggaccaggacagggatggggcctgggtgggtggcggtcacagcgtggcagggtgggggctgggatccgcctacaccccacggtcaggctgctagaaacctgggaacaccccagcacagggtctcagaacagagacctggtacaccaggcccgccgccacccgagggagcccagggagatgggtgcagaggtgtcgcctttaacgtgatgttctctgcccctcacatttagccgactgactgctgcagaccaccgccaactgcagctctccatcagctcctgtctccagcagctttccctgttgatgtggatcacgcagtgctttctgcccgtgtttttggctcagcctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaaactgagctacga

SEQ ID NO: 113914 - DNA, 993 bp, Homo sapiens; identical to SEQ ID NO: 113911
  Payload ID: 2243
  Gene Symbol: CTAG1B
  Gene Name: cancer/testis antigen 1B
  ENST ID: ENST00000595485
  CDS Start-End: 65-697

SEQ ID NO: 113915 - DNA, 993 bp, Homo sapiens
  Payload ID: 2244
  Gene Symbol: CTAG2
  Gene Name: cancer/testis antigen 2
  Uniprot ID: O75638
  ENST ID: ENST00000247306
  CDS Start-End: 65-697
tctgcctccgcatcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttgagttgcacatcacgatgcctttctcgtcgcccatggaagcggagctggtccgcaggatcctgtcccgggatgccgcaccgctcccccgaccaggggcggttctgaaggacttcaccgtgtccggcaacctactgtttatgtcagttcgggaccaggacagggaaggcgctgggcggatgagggtggtgggttgggggctgggatccgcctccccggaggggcagaaagctagagatctcagaacacccaaacacaaggtctcagaacagagacctggtacaccaggcccgccgccacccgagggagcccagggagatgggtgcagaggtgtcgcctttaatgtgatgttctctgcccctcacatttagccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacgattccg

SEQ ID NO: 113916 - DNA, 748 bp, Homo sapiens
  Payload ID: 2244
  Gene Symbol: CTAG2
  Gene Name: cancer/testis antigen 2
  Uniprot ID: O75638
  ENST ID: ENST00000369585
  CDS Start-End: 54-596
atcctcgtgggccctgaccttctctctgagagccgggcagaggctccggagccatgcaggccgaaggccggggcacagggggttcgacgggcgatgctgatggcccaggaggccctggcattcctgatggcccagggggcaatgctggcggcccaggagaggcgggtgccacgggcggcagaggtccccggggcgcaggggcagcaagggcctcggggccgagaggaggcgccccgcggggtccgcatggcggtgccgcttctgcgcaggatggaaggtgcccctgcggggccaggaggccggacagccgcctgcttgagttgcacatcacgatgcctttctcgtcgcccatggaagcggagctggtccgcaggatcctgtcccgggatgccgcaccgctcccccgaccaggggcggttctgaaggacttcaccgtgtccggcaacctactgtttatccgactgactgctgcagaccaccgccaactgcagctctccatcagctcctgtctccagcagctttccctgttgatgtggatcacgcagtgctttctgcccgtgtttttggctcaggctccctcagggcagaggcgctaagcccagcctggcgccccttcctaggtcatgcctcctcccctagggaatggtcccagcacgagtggccagttcattgtgggggcctgattgtttgtcgctggaggaggacggcttacatgtttgtttctgtagaaaataaagctgagctacga

SEQ ID NO: 113917 - DNA, 1445 bp, Homo sapiens
  Payload ID: 2245
  Gene Symbol: CT55
  Gene Name: cancer/testis antigen 55
  Uniprot ID: Q8WUE5
  ENST ID: ENST00000276241
  CDS Start-End: 228-1022
agagggagaagtcagcggagaagctgggagctcctttggaggctgcggtgtccctgactctcctgaggggggctcactaacgggtgggtcccatgccacagtgtctgaggagaagcaggaagtgagtccctgaggagacgccgtgacctgagggcttcccttactgaggaggcctcgtgcttcatctgccacaagcggtgcccaggccggtggtgacaactgggacgatgctcaggcttctgagacttgctttggccttctacgggaggacggccgaccctgcagagcgacagggcccacagcagcagggcctcccacaaggtgacacccagttgacaactgtgcagggagttgtcacaagtttctgtggtgattatggcatgattgatgagtcgatctacttcagtagtgatgttgtgactggcaacgtgcctctaaaagttggacaaaaagttaatgtggttgtggaagaagataaaccacattatggattgagagcaatcaaggtggatgttgtgcctcgccatctttatggtgctggaccctcagactcaggaaccagagttttaattggatgtgttacttctataaatgaagataatatttatattagtaacagcatttatttttccatagccattgtttctgaagattttgtgccttataagggtgacttgttagaagttgaatattccactgagccaggcatctcaaacatcaaggcaacttctgtgaagcccatccgttgtattcatacggaagaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatccagcagcggattccaggatgacggaggcctgggacggcccaaaagggaacgtcggagccaaagcatttaactgaaaaggcatcagggacagcatgttaaaggcatgatttaaagttacaatttgacttcagttttgagccccgttatgctgcctgtacaacctgtattgttccatagcctctttcatcttctgtcacccacataacttgcggtgtttgttgttttacttgttccttcttccccatgctagaatgtaaactccacaatggcaggatgtcttttaatctggtttttttttttcttttttctttctttttttttttctgttgtcattaaagcatcaccaagcacttagaagagtgcctggcagactcaatgagcagataaaatgttattaagttcaatgactgaatgactgggccagcaatgatacttacctgtggttcattcatcactggttccttaggaataaaattgttgagcaatgcactaa

SEQ ID NO: 113918 - DNA, 1728 bp, Homo sapiens
  Payload ID: 2245
  Gene Symbol: CT55
  Gene Name: cancer/testis antigen 55
  Uniprot ID: Q8WUE5
  ENST ID: ENST00000344129
  CDS Start-End: 228-956
agagggagaagtcagcggagaagctgggagctcctttggaggctgcggtgtccctgactctcctgaggggggctcactaacgggtgggtcccatgccacagtgtctgaggagaagcaggaagtgagtccctgaggagacgccgtgacctgagggcttcccttactgaggaggcctcgtgcttcatctgccacaagcggtgcccaggccggtggtgacaactgggacgatgctcaggcttctgagacttgctttggccttctacgggaggacggccgaccctgcagagcgacagggcccacagcagcagggcctcccacaaggtgacacccagttgacaactgtgcagggagttgtcacaagtttctgtggtgattatggcatgattgatgagtcgatctacttcagtagtgatgttgtgactggcaacgtgcctctaaaagttggacaaaaagttaatgtggttgtggaagaagataaaccacattatggattgagagcaatcaaggtggatgttgtgcctcgccatctttatggtgctggaccctcagactcaggaaccagagttttaattggatgtgttacttctataaatgaagataatatttatattagtaacagcatttatttttccatagccattgtttctgaagattttgtgccttataagggtgacttgttagaagttgaatattccactgagccaggcatctcaaacatcaaggcaacttctgtgaagcccatccgttgtattcatacggaagaggtctgcattactagcgtacatggaagaaatggggtgatagattatactatttttttcaccttggattctgtgaaacttcctgatggatacgtacctcaagtagatgatatcgtcaatgtggtcatggtggagagcattcagttctgctttatttggagagcgatttctatcaccccagtgcataaatcgtaatgacaaagcatttttattctgtttatctttccttttatgagcagtaaaggggctggtttaacttaaaaggttagcttagtaagcctaaatagtattttatatatgacttttctggcaaatctaattgagacactggccagtccaactggaccaggaacccagcttagggaaataacttattaattaaaaagcatgctaaattagcttgctagtcactggaggaaaggagttcttaattaaaatgaacacggccattaaatttgaattccatatttcccattagcagcagcggattccaggatgacggaggcctgggacggcccaaaagggaacgtcggagccaaagcatttaactgaaaaggcatcagggacagcatgttaaaggcatgatttaaagttacaatttgacttcagttttgagccccgttatgctgcctgtacaacctgtattgttccatagcctctttcatcttctgtcacccacataacttgcggtgtttgttgttttacttgttccttcttccccatgctagaatgtaaactccacaatggcaggatgtcttttaatctggtttttttttttcttttttctttctttttttttttctgttgtcattaaagcatcaccaagcacttagaagagtgcctggcagactcaatgagcagataaaatgttattaagttcaatgactgaatgactgggccagcaatgatacttacctgtggttcattcatcactggttccttaggaataaaattgttgagcaatgca

SEQ ID NO: 113919 - DNA, 1825 bp, Homo sapiens
  Payload ID: 2246
  Gene Symbol: CT62
  Gene Name: cancer/testis antigen 62
  Uniprot ID: P0C5K7
  ENST ID: ENST00000449977
  CDS Start-End: 508-918
ggagagctctggctcagagtttgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccagggtcgtctaagtgagaggaaaagggagagggcggttgagaccaggccctgaattccgcgttcatcttatcctgaggtattcagtgccgagtgtggccttggtgctaggattcaaagaggaaaggaagaaaactttccattctaaaagaaactccacgtgaggcgaagaagatgaaatatagtcagaaaaccataccagtaggtgttaagttgataaatgatgcatacgacatcctatagaagactgtcaccaccccacctcactgatcagccctctgcctacagccacacccacagaacattcagccatttctcctgtggttcccagcctgcagcacagcgtctgcacgtggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 113920 - DNA, 982 bp, Homo sapiens
  Payload ID: 2246
  Gene Symbol: CT62
  Gene Name: cancer/testis antigen 62
  ENST ID: ENST00000567117
  CDS Start-End: 692-982
tgcgatccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccagggtcgtctaagtgagaggaaaagggagagggcggttgagaccaggccctgaattccgcgttcatcttatcctgaggtctgtggggacctgttgaaggactggggcaggggacggacgcgggcatccttccatttggaacagccattccggcagcatcaggatggggcggaggcaaagcggggagtgggcgaggcaagtggtgctgtaaacctgtgcgagaagggggcggtgactctaagggcaggaaggagccctggtcacacacacactcccacgcaaggtattcagtgccgagtgtggccttggtgctaggattcaaagaggaaaggaagaaaactttccattctaaaagaaactccacgtgaggcgaagaagatgaaatatagtcagaaaaccataccagtaggtgttaagttgataaatgatgcatacgacatcctatagaagactgtcaccaccccacctcactgatcagccctctgcctacagccacacccacagaacattcagccatttctcctgtggttcccagcctgcagcacagcgtctgcacgtggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggat

SEQ ID NO: 113921 - DNA, 2822 bp, Homo sapiens
  Payload ID: 2246
  Gene Symbol: CT62
  Gene Name: cancer/testis antigen 62
  ENST ID: ENST00000566432
  CDS Start-End: 784-1017
ccgagagcgggatccgcgctccctcggtccttcctccctcccctcttgcggcctcccgctgtcatctggagccgctcctgccgccccctggcggcgaccgcgggaagggccggcccccatccgcacccctgaccccggaggtcaacaacgggatggtccctgggtcccaggggaagagacatcacccagtaggagggagtacggtctagacagaggccacgagggcgggagggggcgagagtggagagtggcccagctggccagggtcgtctaagtgagaggaaaagggagagggcggttgagaccaggccctgaattccgcgttcatcttatcctgaggtctgtggggacctgttgaaggactggggcaggggacggacgcgggcatccttccatttggaacagccattccggcagcatcaggatggggcggaggcaaagcggggagtgggcgaggcaagtggtgctgtaaacctgtgcgagaagggggcggtgactctaagggcaggaaggagccctggtcacacacacactcccacgcaaggtattcagtgccgagtgtggccttggtgctaggattcaaagaggaaaggaagaaaactttccattctaaaagaaactccacgtgaggcgaagaagatgaaatatagtcagaaaaccataccagtaggtggtaggtaaatgcagaagtatttaagagctcatacaggagtacctgcctcaggacagggaatctgagatgctctgcagagctggatcttaaagaacggattaagttgataaatgatgcatacgacatcctatagaagactgtcaccaccccacctcactgatcagccctctgcctacagccacacccacagaacattcagccatttctcctgtggttcccagcctgcagcacagcgtctgcacgtggtgagggctcccaaatctctgaggaatgaatggctcactgctgagagcaaccttctgggagttcagggcatgtggaactggaataagagcaacgtgtgaacagattacaggaaggcaatgcaggacagctggaccctttggggggaaacttatggggaacacagttttcttacttataagcactgagattgcctgagaggggagagatgatgcagagtgtcccaaatgtatttgacgtggaatccttttaccagcgaaacatctcttgggcctagagttctgaaaattgcactttgaaaaacactgctctcagctcttacaaacctcgtgttttcatcctaactgtgcttcagagaattgtgtcccagcaggaaaggaaacccccgtataattccctacgttgctagcatttggaagtgggatgaaaatggacctacattcaaacccctaatttcaagctctgaaggaggtaccaggatccatcacgatgcttgtaaaattgttcctttcattttcctggttgtaaacttatgcagactgtaaagtcaaggcaagcctgtgcccagcaaataataagaaaataagggaggcatggtaaacaaaacaaaacactttgagagttggtcaacttgctgttattttgagctgtttctaaaaatctcagggtagattccctcccctgcttgcctccttaacccagtcctttttcttcctcctccaggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcaggttatctccttctctttcccttttctgcttcacacttgctctcatcctctttctcaccccacatctggtcagaggagataggaaggttcttgttacctggtacaagacaacttttggaatcccagatattcagattatttccccttttcctctttgcaaatgataatactcacagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtagtggctgttgatcagctgatatggaagtatgtcattttattaacaattgagaaaggagtgctgtgcaattccattcaatgccagtgatgcttatggccgtttttatgagttctgtcattttcaaatgagcaagaggaagcctctaagggggtttaagcagggactgacgtaatcagatctgtgtttttccaaagggagagggagaaaaagaacatttcttatttttcaaaaaaggtaatgcaaaagcatcattccacaattctcttgtaatgaaaaaaataaatgcaaacttaagcaaatccatcattctgaaagaa

SEQ ID NO: 113922 - DNA, 693 bp, Homo sapiens
  Payload ID: 2246
  Gene Symbol: CT62
  Gene Name: cancer/testis antigen 62
  ENST ID: ENST00000564862
  CDS Start-End: 1-310
ggaactctggaatgctgacctacagtctgagttcctgtgcccttgcctggggctgactctctacttgacctgtaacccacaactgggcaagagaaaattctgcagccacagctctgaggacatgagcaaaatggtttccagacggaatgtcaaggattcccatgaagtgtcagggagtcttcaggccacacttcagccaagaggcatcacccggatccgaggctgcttctccttaggacatgcagacagaaggagaaggcggggctggcagcctccagtccacagcctccctttcttcttccggcgatgattaactaggcctagacaatggagatctacggcatacgcccagggcctcctcttctcaagcatggctgatcagtcactttcccgtctatccttcatttattgaagccaactatgaacgactaaaggaaggatgagaaaagtcacccaaagtcaaaggggacagcgtgggagactgttctagacagaaggaaacacctttgcaaagaccctgaggaaggcaggggactctccaggagcagaagggctgtgtggcttcagagtccacaaaagagagcagatacaggacactggctagagcaggccctggagcccgctgctgtcctggaggccttggggaggcccagtgttcccagggtggaagaagtaggggacagcttgacgtag

SEQ ID NO: 113923 - DNA, 548 bp, Homo sapiens
  Payload ID: 2247
  Gene Symbol: CT83
  Gene Name: cancer/testis antigen 83
  Uniprot ID: Q5H943
  ENST ID: ENST00000371894
  CDS Start-End: 148-489
ataaagcgggacaacacagaacttcccagttacaccaggcatcctggcccaaagtttcccaaatccaggcggctagaggcccactgcttcccaactaccagctgagggggtccgtcccgagaagggagaagaggccgaagaggaaacatgaacttctatttactcctagcgagcagcattctgtgtgccttgattgtcttctggaaatatcgccgctttcagagaaacactggcgaaatgtcatcaaattcaactgctcttgcactagtgagaccctcttcttctgggttaattaacagcaatacagacaacaatcttgcagtctacgacctctctcgggatattttaaataatttcccacactcaatagccaggcagaagcgaatattggtaaacctcagtatggtggaaaacaagctggttgaactggaacatactctacttagcaagggtttcagaggtgcatcacctcaccggaaatccacctaaaagcgtacaggatgtaatgccagtggtggaaatcattaaagacactttgagtagattca

SEQ ID NO: 113924 - DNA, 1087 bp, Homo sapiens
  Payload ID: 2248
  Gene Symbol: CT45A1
  Gene Name: cancer/testis antigen family 45, member A1
  Uniprot ID: Q5HYN5
  ENST ID: ENST00000594117
  CDS Start-End: 12-581
ttcaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaagcattttatttgaaaggataacttgtgttttggttattttgtattcccacctgtgctggtagatattattaacccattaggtaaatactattacagtcgtggtttctgcagcagctcacagtgttgtagctggtatttatcactacgttctttcgctacccatttcacattccctttgccctgagatagcatgtcagttggtcatgatgcttggcctggcaggatgactcaaaccttcattacggaagagtctgaaccattagatgtcctgcctggatggggttgctgtgatcttccattaactctaatcg

SEQ ID NO: 113925 - DNA, 1007 bp, Homo sapiens
  Payload ID: 2248
  Gene Symbol: CT45A1
  Gene Name: cancer/testis antigen family 45, member A1
  Uniprot ID: Q5HYN5
  ENST ID: ENST00000594565
  CDS Start-End: 245-814
agtgttcggctgggccagcacactgtggctggctgcttcccttccttccatcccctttggaccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgctgctgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagcaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttccca

SEQ ID NO: 113926 - DNA, 578 bp, Homo sapiens
  Payload ID: 2249
  Gene Symbol: CT45A10
  Gene Name: cancer/testis antigen family 45, member A10
  Uniprot ID: P0DMU9
  ENST ID: ENST00000617981
  CDS Start-End: 9-578
aggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttga

SEQ ID NO: 113927 - DNA, 1010 bp, Homo sapiens
  Payload ID: 2249
  Gene Symbol: CT45A10
  Gene Name: cancer/testis antigen family 45, member A10
  Uniprot ID: P0DMU9
  ENST ID: ENST00000611668
  CDS Start-End: 246-815
agtgttcggctggggcaggcacgctgtggctggctacttcccttccttccatcccccttgggccaaacaggatcggtgcttctggtgagacgcctccccatgcacatcactcccaggtaccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcaatttctctggagatgacctagaatgcagaggaatagcctcctctcccaaaagccaacaagaaattaatgctgatataaaatgtcaagtagtgaaggaaatccgatgccttggacgaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaa

SEQ ID NO: 113928 - DNA, 1076 bp, Homo sapiens
  Payload ID: 2250
  Gene Symbol: CT45A2
  Gene Name: cancer/testis antigen family 45, member A2
  Uniprot ID: Q5DJT8
  ENST ID: ENST00000605791
  CDS Start-End: 1-570
atgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagccttctctcccaaaagccaacaagaaattaatgctgatataaaacgtcaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaagcgttttatttgaaaggataacttgtgttttggttattttgtattcccacctgtgctggtagatattattaacccattaggtaaatactattacagtcgtggtttctgcagcagctcacactgatgtagctggcgtttataactaccttctttcgctacccgtttcgcattccctttgccctgagatagcatgtcagttggtcatgatgcttggcctggcaggatgactcaaaccttcattacagaagagtctgaaccattagatatcctgcctggatggggttgctgtgattttccattaactctaatcg

SEQ ID NO: 113929 - DNA, 1008 bp, Homo sapiens
  Payload ID: 2250
  Gene Symbol: CT45A2
  Gene Name: cancer/testis antigen family 45, member A2
  Uniprot ID: Q5DJT8
  ENST ID: ENST00000612907
  CDS Start-End: 246-815
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagccttctctcccaaaagccaacaagaaattaatgctgatataaaacgtcaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttccca

SEQ ID NO: 113930 - DNA, 1076 bp, Homo sapiens
  Payload ID: 2251
  Gene Symbol: CT45A3
  Gene Name: cancer/testis antigen family 45, member A3
  Uniprot ID: Q8NHU0
  ENST ID: ENST00000597510
  CDS Start-End: 1-570
atgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaagcattttatttgaaaggataacttgtgttttggttattttgtattcccacctgtgctggtagatattattaacccattaggtaaatactattacagtcgtggtttctgcagcagctcacagtgttgtagctggtatttatcactacgttctttcgctacccatttcacattccctttgccctgagatagcatgtcagttggtcatgatgcttggcctggcaggatgactcaaaccttcattacggaagagtctgaaacattagatgtcctgcctggatggggttgctgtgatcttccattaactctaatcg

SEQ ID NO: 113931 - DNA, 855 bp, Homo sapiens
  Payload ID: 2251
  Gene Symbol: CT45A3
  Gene Name: cancer/testis antigen family 45, member A3
  Uniprot ID: Q8NHU0
  ENST ID: ENST00000598716
  CDS Start-End: 91-660
agtgttcggctggggcaggcacgctgtggctggctacttcccttcctcccatcccccttgggccaaacgggatcggtgcttctggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaaatagccttccagaggctaagaaatttctgttagtaaaagatgttctttttcccaaa

SEQ ID NO: 113932 - DNA, 1161 bp, Homo sapiens
  Payload ID: 2252
  Gene Symbol: CT45A5
  Gene Name: cancer/testis antigen family 45, member A5
  Uniprot ID: P0DMU8
  ENST ID: ENST00000487941
  CDS Start-End: 86-655
gtggggaggcgccacaacttcactgccattttgtgaggtgccgccgtctctcctccagcaaggtcaggacttcaggactgaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaagcgttttatttgaaaggataacttgtgttttggttattttgtattcccacctgtgctggtagatattattaacccattaggtaaatactattacagtcgtggtttctgcagcagctcacactgatgtagctggcgtttataactaccttctttcgctacccgtttcgcattccctttgccctgagatagcatgtcagttggtcatgatgcttggcctggcaggatgactcaaaccttcattacggaagagtctgaaccattagatatcctgcctggatggggttgctgtgattttccattaactctaatcg

SEQ ID NO: 113933 - DNA, 726 bp, Homo sapiens
  Payload ID: 2252
  Gene Symbol: CT45A5
  Gene Name: cancer/testis antigen family 45, member A5
  Uniprot ID: P0DMU8
  ENST ID: ENST00000617203
  CDS Start-End: 1-570
atgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggct

SEQ ID NO: 113934 - DNA, 878 bp, Homo sapiens
  Payload ID: 2253
  Gene Symbol: CT45A6
  Gene Name: cancer/testis antigen family 45, member A6
  Uniprot ID: P0DMU7
  ENST ID: ENST00000620654
  CDS Start-End: 153-722
ctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggct

SEQ ID NO: 113935 - DNA, 770 bp, Homo sapiens
  Payload ID: 2253
  Gene Symbol: CT45A6
  Gene Name: cancer/testis antigen family 45, member A6
  Uniprot ID: P0DMU7
  ENST ID: ENST00000612878
  CDS Start-End: 9-578
aggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttccc

SEQ ID NO: 113936 - DNA, 578 bp, Homo sapiens
  Payload ID: 2254
  Gene Symbol: CT45A7
  Gene Name: cancer/testis antigen family 45, member A7
  Uniprot ID: P0DMV0
  ENST ID: ENST00000620885
  CDS Start-End: 9-578
aggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttga

SEQ ID NO: 113937 - DNA, 996 bp, Homo sapiens
  Payload ID: 2254
  Gene Symbol: CT45A7
  Gene Name: cancer/testis antigen family 45, member A7
  Uniprot ID: P0DMV0
  ENST ID: ENST00000610598
  CDS Start-End: 234-803
gggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagatgggatgatgcagaaacctggtagcaatgcacctgtgggaggaaacgttaccagcagtttctctggagatgacctagaatgcagagaaacagcctcctctcccaaaagccaacgagaaattaatgctgatataaaacgtaaattagtgaaggaactccgatgcgttggacaaaaatatgaaaaaatcttcgaaatgcttgaaggagtgcaaggacctactgcagtcaggaagcgattttttgaatccatcatcaaggaagcagcaagatgtatgagacgagactttgttaagcaccttaagaagaaactgaaacgtatgatttgagaatacttgtccctggaggattatcacaccccaaatgcataatctcgttaatgattgaggagagaaaaggatcagattgctgttttctacaatggagcaggatattgctgaagtctcctggcatatgttaccgaatcaactggccttccagaggctaagaaatttctgttagtaaaagatgttctttttccca

SEQ ID NO: 113938 - DNA, 770 bp, Homo sapiens
  Payload ID: 2255
  Gene Symbol: CT45A8
  Gene Name: cancer/testis antigen family 45, member A8
  Uniprot ID: P0DMV1
  ENST ID: ENST00000611438
  CDS Start-End: 9-578
aggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagccttctctcccaaaagccaacaagaaattaatgctgatataaaacgtcaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttccc

SEQ ID NO: 113939 - DNA, 1008 bp, Homo sapiens; identical to SEQ ID NO: 113929
  Payload ID: 2255
  Gene Symbol: CT45A8
  Gene Name: cancer/testis antigen family 45, member A8
  Uniprot ID: P0DMV1
  ENST ID: ENST00000611660
  CDS Start-End: 246-815

SEQ ID NO: 113940 - DNA, 770 bp, Homo sapiens; identical to SEQ ID NO: 113938
  Payload ID: 2256
  Gene Symbol: CT45A9
  Gene Name: cancer/testis antigen family 45, member A9
  Uniprot ID: P0DMV2
  ENST ID: ENST00000604569
  CDS Start-End: 9-578

SEQ ID NO: 113941 - DNA, 1010 bp, Homo sapiens
  Payload ID: 2256
  Gene Symbol: CT45A9
  Gene Name: cancer/testis antigen family 45, member A9
  Uniprot ID: P0DMV2
  ENST ID: ENST00000620704
  CDS Start-End: 246-815
agtgttcggctggggcaggcacgctgtggctggctacttcccttcctcccatcccccttgggccaaacgggatcggtgcttctggtgagacgcctccccatgcacatcactcccaggtgccctagggggcacatttcccacaactcccagagggcaggtttctagaaagtgccaccagtggggaggcgccacaacttcactgccattttgtgaggtgccgccgtctctcctccagcaaggaaacaatgaccgataaaacagagaaggtggctgtagatcctgaaactgtgtttaaacgtcccagggaatgtgacagtccttcgtatcagaaaaggcagaggatggccctgttggcaaggaaacaaggagcaggagacagccttattgcaggctctgccatgtccaaagaaaagaagcttatgacaggacatgctattccacccagccaattggattctcagattgatgacttcactggtttcagcaaagataggatgatgcagaaacctggtagcaatgcacctgtgggaggaaacgttaccagcagtttctctggagatgacctagaatgcagagaaacagccttctctcccaaaagccaacaagaaattaatgctgatataaaacgtcaattagtgaaggaactccgatgcgttggacaaaaatatgaaaaaatcttcgaaatgcttgaaggagtgcaaggacctactgcagtcaggaaacgattttttgaatccatcatcaaggaagcagcaagatgtatgagacgagactttgttaagcaccttaagaagaaactgaaacgtatgatttgagaatacttgtccctggaggattatcacaccccaaatgcataatctcattaatgattgaggagagaaaaggatcagattgctgttttctacaatggagcaggatattgctgaagtctcctggcatatgttaccgaatcaactggccttccagaggctaagaaatttctgttagtaaaagatgttctttttcccaaa

SEQ ID NO: 113942 - DNA, 1298 bp, Homo sapiens
  Payload ID: 2257
  Gene Symbol: CT47A1
  Gene Name: cancer/testis antigen family 47, member A1
  Uniprot ID: Q5JQC4
  ENST ID: ENST00000433030
  CDS Start-End: 260-1126
gccaaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 113943 - DNA, 1298 bp, Homo sapiens
  Payload ID: 2258
  Gene Symbol: CT47A10
  Gene Name: cancer/testis antigen family 47, member A10
  Uniprot ID: Q5JQC4
  ENST ID: ENST00000430448
  CDS Start-End: 260-1126
gccaaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 113944 - DNA, 1294 bp, Homo sapiens
  Payload ID: 2259
  Gene Symbol: CT47A11
  Gene Name: cancer/testis antigen family 47, member A11
  Uniprot ID: Q5JQC4
  ENST ID: ENST00000457020
  CDS Start-End: 256-1122
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 113945 - DNA, 1165 bp, Homo sapiens
  Payload ID: 2260
  Gene Symbol: CT47A12
  Gene Name: cancer/testis antigen family 47, member A12
  Uniprot ID: Q5JQC4
  ENST ID: ENST00000419982
  CDS Start-End: 260-1126
gccaaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccaggtatctgt

SEQ ID NO: 113946 - DNA, 1298 bp, Homo sapiens; identical to SEQ ID NO: 113943
  Payload ID: 2261
  Gene Symbol: CT47A2
  Gene Name: cancer/testis antigen family 47, member A2
  Uniprot ID: Q5JQC4
  ENST ID: ENST00000458218
  CDS Start-End: 260-1126

SEQ ID NO: 113947 - DNA, 1298 bp, Homo sapiens; identical to SEQ ID NO: 113943
  Payload ID: 2262
  Gene Symbol: CT47A3
  Gene Name: cancer/testis antigen family 47, member A3
  Uniprot ID: Q5JQC4
  ENST ID: ENST00000441330
  CDS Start-End: 260-1126

SEQ ID NO: 113948 - DNA, 1298 bp, Homo sapiens; identical to SEQ ID NO: 113943
  Payload ID: 2263
  Gene Symbol: CT47A4
  Gene Name: cancer/testis antigen family 47, member A4
  Uniprot ID: Q5JQC4
  ENST ID: ENST00000415858
  CDS Start-End: 260-1126

SEQ ID NO: 113949 - DNA, 1298 bp, Homo sapiens; identical to SEQ ID NO: 113943
  Payload ID: 2264
  Gene Symbol: CT47A5
  Gene Name: cancer/testis antigen family 47, member A5
  Uniprot ID: Q5JQC4
  ENST ID: ENST00000439466
  CDS Start-End: 260-1126

SEQ ID NO: 113950 - DNA, 1294 bp, Homo sapiens
  Payload ID: 2264
  Gene Symbol: CT47A5
  Gene Name: cancer/testis antigen family 47, member A5
  Uniprot ID: Q5JQC4
  ENST ID: ENST00000416816
  CDS Start-End: 256-1122
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 113951 - DNA, 1298 bp, Homo sapiens
  Payload ID: 2265
  Gene Symbol: CT47A6
  Gene Name: cancer/testis antigen family 47, member A6
  Uniprot ID: Q5JQC4
  ENST ID: ENST00000419194
  CDS Start-End: 260-1126
gccaaccagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccagccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 113952 - DNA, 1294 bp, Homo sapiens
  Payload ID: 2265
  Gene Symbol: CT47A6
  Gene Name: cancer/testis antigen family 47, member A6
  Uniprot ID: Q5JQC4
  ENST ID: ENST00000618867
  CDS Start-End: 256-1122
accagaatctttcccaacttgtctaagtcctctcaggccagccttggtgggaggtttctaggattcgctccctgcccttcccatcttagggtgtcgtctgagacagactcttattccctcaataaagagagagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccagccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 113953 - DNA, 1288 bp, Homo sapiens
  Payload ID: 2266
  Gene Symbol: CT47A7
  Gene Name: cancer/testis antigen family 47, member A7
  Uniprot ID: Q5JQC4
  ENST ID: ENST00000434883
  CDS Start-End: 256-1122
accagaatctttcccgccttatctaagtcctctcaggccagacttggtgggaggttcctaggattcgctccctgcccttcccaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaa

SEQ ID NO: 113954 - DNA, 1298 bp, Homo sapiens; identical to SEQ ID NO: 113943
  Payload ID: 2267
  Gene Symbol: CT47A8
  Gene Name: cancer/testis antigen family 47, member A8
  Uniprot ID: Q5JQC4
  ENST ID: ENST00000457977
  CDS Start-End: 260-1126

SEQ ID NO: 113955 - DNA, 1039 bp, Homo sapiens
  Payload ID: 2267
  Gene Symbol: CT47A8
  Gene Name: cancer/testis antigen family 47, member A8
  Uniprot ID: Q5JQC4
  ENST ID: ENST00000630126
  CDS Start-End: 1-867
atgtctgccacaggggaccgacacccgacccaaggggaccaggaggccccggtaagccaggagggagcacaggccgaggcggccggagctggtaaccaggagggcggcgactccggccccgacagcagcgacgtggtgcctgcggccgaggtggtcggagtcgcagggcccgtggaaggcctcggggaggaggagggtgagcaggcggcaggcctggccgcagtcccccggggcgggagcgccgaggaggactcagatatcgggcccgcgacggaggaagaggaggaggaagaggggaacgaggcggccaacttcgacttggcggtggtcgcccgtcgctacccggcgtcgggcattcacttcgtgctcctggacatggtccactcccttctccaccgcctctctcacaacgaccacatcctcatagagaaccgtcaactcagccgcctgatggtggggccacacgctgctgcgcgcaacctctggggcaacctccccccgctgctgctgccccagaggctgggtgcaggggccgcagcccgggcgggcgagggcctgggcctgatccaggaggccgcatcggtcccagagcctgcagtgccagctgacctggccgagatggccagggagcccgcggaggaggccgcagaggagaagctctcagaggaggccacagaggaaccagacgcagaggaaccggccacagaagaaccgaccgcacaggaggccacggccccagaggaagtcactaaatctcagcccgaaaagtgggatgaagaggcccaagatgctgcaggcgaggaagagaaagaacaagaaaaagagaaggatgcagaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgttcaagttaaaaaataaaagtttgttttaaatgaataaactgaaa

SEQ ID NO: 113956 - DNA, 1298 bp, Homo sapiens; identical to SEQ ID NO: 113943
  Payload ID: 2268
  Gene Symbol: CT47A9
  Gene Name: cancer/testis antigen family 47, member A9
  Uniprot ID: Q5JQC4
  ENST ID: ENST00000417256
  CDS Start-End: 260-1126

SEQ ID NO: 113957 - DNA, 1328 bp, Homo sapiens
  Payload ID: 2269
  Gene Symbol: CT47B1
  Gene Name: cancer/testis antigen family 47, member B1
  Uniprot ID: P0C2W7
  ENST ID: ENST00000371311
  CDS Start-End: 260-1159
gccaaccagaatctttcccgccttatctaagtcctctcaggccagacttggtgggaggttcctaggattcgctccctgcccttcccaccttagggtgtcctctgagacagactcttatttcctcaataaagagaaagactcttattccctcagcggccagctcctcgcctcccctcggccgtagccacctcagtggtcaccgtcttcaccgtggtcgcctcagcccgctcgccaccccagttgaggcgctgctggtgtcatgtctgccacaggggaccgacacccgacccaaggggaccaggaggccccggtaagccaggagggagcacaggccgaggcggccggagctggtaaccaggagggcggcgactccggccccgacagcagcgacatggtgcctgcggccgaggtggtcggagtcgcagggcccgtggaaggcctcggggaggaggagggtgagcaggcggcaggcctggccgcagtcccccagggcgggagcgccgaggaggactcagatatcgggcccgcgacggaggaagaggaggaggaggaagaggggaacgaggcggccaacttcgacttggcggtggccacccgtcggtacccggcggcgggcattggcttcgtgttcctgtacctggtccactcccttctccgccgcctctatcacaacgaccacatccagatagcgaaccgtcacctcagccgcctgatggtggggccccacgctgctgtgcccaacctctgggacaaccctcccctgctgctgctgtcccagaggctgggtgcaggggctgcagccccagaaggcgagggcctcggcctgatccaggaggctgcgtcggtccaggaggccgcgtcggtcccagagcctgcagtgccagctgacctggccgagatggccagggagcccgcggaggaggccgcagatgagaaacccccagaggaggccgcagaggagaagctcacagaggaggccacagaggaaccggccgcagaggaaccgacctcagaggaggccgtggcccccgaggaagtcactaaatctcagcccgaaaagtgggatgaagaggcccaagatgctgcaggcgaggaagagaaagaacaagaaaaagagaaggatgtggaaaacaaggtgaagaactccaaagggacctagacgcagcagaggtgaagccaagaaaatccagatgcctgtgggaattgtaacacatatcattccaaagttcgttacatcaaaagtgatatccagtgacatctaactttcatggatgtatgtgacagtgtttgttcaagttaaaaataaaagtttgttttcaatgaataaa

SEQ ID NO: 113958 - DNA, 1252 bp, Homo sapiens
  Payload ID: 2270
  Gene Symbol: CNR1
  Gene Name: cannabinoid receptor 1 (brain)
  ENST ID: ENST00000362094
  CDS Start-End: 1-111
atgaagtcgatcctagatggccttgcagataccaccttccgcaccatcaccactgacctcctgtacgtgggctcaaatgacattcagtacgaagacatcaaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 113959 - DNA, 5549 bp, Homo sapiens
  Payload ID: 2270
  Gene Symbol: CNR1
  Gene Name: cannabinoid receptor 1 (brain)
  Uniprot ID: P21554
  ENST ID: ENST00000369499
  CDS Start-End: 151-1569
ttagcttatcaggagaacttactgtaaaccgactctttttgtttcaaagatgtctcccactccaggcgaggagcgctcttggctgaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatg

SEQ ID NO: 113960 - DNA, 6031 bp, Homo sapiens
  Payload ID: 2270
  Gene Symbol: CNR1
  Gene Name: cannabinoid receptor 1 (brain)
  Uniprot ID: P21554
  ENST ID: ENST00000369501
  CDS Start-End: 621-2039
cgagagggagccagagacagcgcgagcggagggagcggcagggactgcgcgagcgggacgaggcgacgggcgcccgggctggcggagacgggcggccccacgccgggccaggcggggctcgcgggaggacccagtgaagagcctgggaaggggcgaggctcgccggcggtcggagcagcggggcgccagtcccggtcgctgtcgcgggcgggcgctggagaccgggacgccggcgctcggacggactgacttgctgaccgcccgccggaggcacaccccactccaccccaccccgcctcgccagcagcccggcgccggcgccgcctcccgcacgctactccctctgccaccccttccttctccacttcttttccgcctccgcctcttcttgtctcccgcggcgccagcgccttcccttggcccgggcgggggcctcggctccctgcagagctctccgtagtcagtgggggatatttcgttctagcggacaaccagcccctgagctgggcgagaggtgccaagggagcttctgtcccgaggaccaggggatgcgaagggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttcaaatatctctatttaattttgacactgaaataaccgtaaaggtttatttttctgttacctcaacaagaagaatttgaagacttcaaaatattgagcagaattcattcatacttaaaaatttattagccctgcattttcataggaagacacattatcttctggactatagctgttctaatggattataatcagaatggaagagagaaagcatattgactttttttgagcgacatctctgactttctttagtctttagctattactggatctcttaagacagcatgtgttaatcttaatgtatatcgttatcactgtgcagttgctgtttacttgaatagtattgtgttcctatattccaggtttaagtagatttcatgcctgggtggccaaacaacagtcttcattttttttaattgaaaagaagtagtgtctggatcagtaaaattatactgtgtgtgagtgtgaatataaatgtgtgtatgtgtgtttctgtcctgtaactgttacagtaatgtcataaagtgagaaaactgtgaccaagtataaacttttaccacttgctgcactcttgcacatggattcagtttctaaaattgagttcttcctgtaatcttgttgataaaaatactgactccaaccattcaaaaatttcaccccatccctccttaagagattggatcaagtattactaaattgacctttaggtattacacaagaccagtgcttagcaaaaaataatgacaggcatccaaggaagggatgtatttgtagtgttattgccaggaaaggagagtactttggtttctgagcaccgaatattgagcaatatgtcagtcactaaaaggaagacagttctacagaaaaacaatggtaacatttttcaatagcgtgtgtagatagtatgcactatatacatcacgttaaagtaggactatcacacccagcccatgtggctaaaaaagctgaatcagacagtggatgagacacacaacggcagtgaagaaccgatacacttggcattgacgtctagctatgctgtatctgtgctttgcccacatgcccttggtgacagctgagcacccagctctgtcttggtaggtttgggctaaggaacaaatctctcctttgctcgtggttagcaagatacactcaagcatgaagataaacacagctgctttcttcttacaccccggtctcatgctccttaatggcgccatgggtgcttgttgggcctttttccagtaaggaatgatattgctgaagaatctacttaaccctgacaaattttaattataatctcttcttatacagataaaacatgactcctacaaggccccaaggtttacatagtctgaagtgaagtacagagctggcatctatctggtgatttctagctctcgagatacccaagcagcctgatggggcagttccccttcttacggttcacgctctaaggcaggatgtggcttatgagatactttgcattgtctgtctgcacaccttgaatctgcctgctggctcccttactttacctctctgtcatgtgcagatgaaggctcagggtgctagaggattagtaagatctctttctaaagacaggagagattatttacaagaagaactcaccagggtttagtttgcatttaagaattgccagtcttttgtcctgcatcatcttgaacattaatccacatgtttcagagctcaccaggcagtaccaatgctcttttcacagctatgaagagctagagaaattcttgttatggtagaaaaatttcacgattcatttttgaaactgcatttgtgcgtatgcagtgtagattttatagtgtgttgtgctttcaagatctaaatcatatataataaattaagggacaatggggctgacagcactaaacttggtgcttattgatattctaagaaatatctgtgaaatatcatcacgtatgttatacaaccttcatttaaaaaggtttaaaactagttagattcactttgacacttttcatatcatttcttaacccaagtgacgaaaacattgtccccaatgaatatactcattagaattaccatttgttaatatcactcattaattaaccccataattagatccattaatttaaatgatttaaatttaagtaagttttataaggtctgacatcagaggtatcttactttcctctgaggatgatgtacttgccctgaccatgcattttaccatcacacatgttcagaaagggccaaattcccaacctgctcattttttttttatcagagtcatgatgaatcagtcctagaatgtttcatttgcacaagtagggctgcctccaagaggaacctctgatttattttgtatgaaatatatgtgaaaggatatgaatctgagagatgctgtagacatctgtcctacacttgagatgatttccaagcctctctggcactttgagttaagtctatctggtattaaatgccaaggaccttttgctgcctaaatccactctgcaggaaataggcccaaccaccagatgagaattaggccctggatgagtagcgctatagttactgtcctgttgattaatttctgccatttcatgtccataaaagagaccacccatatcatgcacacaattagatttctcacactctaactgtatatttgtatgatattttaaaatctcctaaatgctgggcaatggctattaacaattaattgtcttgcactggccttctgatgaaatgttaacaatgcctattgtaatatagaaaaaaacattctatctactgatttgggctgaatgtatgtaaataggtttctaaaaagtcagatgtttgagcagtggcctacaaatcagtaattttcggatgggagagtttctttacattgccgtggcatcttaaaagctatcttcatgtaaattgactgtactaggcctactggggatcagagttcccaagaaaggaaaccttttcttgtatctggattcaaatttatttccaatgtttcaagcgggaaacatgactctttattgtctgtaaatctaacattattacttttcctcttagaagaatattgtattgttagatgtttgttgagctggtaacatcgttgcaaccactgcaatatcttcgttagtaatctgtataatactttgtatacaagtactggtaagattgttattaaatgtagcttcagtcattaaattactatagcaaagtagtacttcttctgtaatatttacaatgtattaagcccacagtatattttatttcaatgtaattaaactgttaacttattcaaagagaaaacatctcatcatgtctattgtccaaagttacctggaatcaaataaaaattctagattaccatgaagaacataaaa

SEQ ID NO: 113961 - DNA, 1550 bp, Homo sapiens
  Payload ID: 2270
  Gene Symbol: CNR1
  Gene Name: cannabinoid receptor 1 (brain)
  Uniprot ID: P21554
  ENST ID: ENST00000428600
  CDS Start-End: 132-1550
cagttgcataaagaacatagatgagagctttcattccctgctgaaaaggatgccatgcctccaccagtgattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 113962 - DNA, 1320 bp, Homo sapiens
  Payload ID: 2270
  Gene Symbol: CNR1
  Gene Name: cannabinoid receptor 1 (brain)
  Uniprot ID: P21554
  ENST ID: ENST00000468898
  CDS Start-End: 1-1320
atgaagtcgatcctagatggccttgcagataccaccttccgcaccatcaccactgacctcctgggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtga

SEQ ID NO: 113963 - DNA, 591 bp, Homo sapiens
  Payload ID: 2270
  Gene Symbol: CNR1
  Gene Name: cannabinoid receptor 1 (brain)
  ENST ID: ENST00000551417
  CDS Start-End: 358-591
gcagagctctccgtagtcagtgggggatatttcgttctagcggacaaccagcccctgagctgggcgagaggtgccaagggagcttctgtcccgaggaccaggggatgcgaaggatgtctcccactccaggcgaggagcgctcttggctgagggcaaagagattgaaagaggggagtcacataatcagcatacgtttatgaagattacccccacagctgtgtggcaagtgatcaaaaaggaacaggaccagagaagagcaggaaaactggtcagaaagcaggcgccctaaccctggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacatt

SEQ ID NO: 113964 - DNA, 2122 bp, Homo sapiens
  Payload ID: 2270
  Gene Symbol: CNR1
  Gene Name: cannabinoid receptor 1 (brain)
  Uniprot ID: P21554
  ENST ID: ENST00000549890
  CDS Start-End: 92-1510
tcggcttatttgttttccctcctcttaggattgccccctgtgggtcactttctcagtcattttgagctcagcctaatcaaagactgaggttatgaagtcgatcctagatggccttgcagataccaccttccgcaccatcaccactgacctcctgtacgtgggctcaaatgacattcagtacgaagacatcaaaggtgacatggcatccaaattagggtacttcccacagaaattccctttaacttcctttaggggaagtcccttccaagagaagatgactgcgggagacaacccccagctagtcccagcagaccaggtgaacattacagaattttacaacaagtctctctcgtccttcaaggagaatgaggagaacatccagtgtggggagaacttcatggacatagagtgtttcatggtcctgaaccccagccagcagctggccattgcagtcctgtccctcacgctgggcaccttcacggtcctggagaacctcctggtgctgtgcgtcatcctccactcccgcagcctccgctgcaggccttcctaccacttcatcggcagcctggcggtggcagacctcctggggagtgtcatttttgtctacagcttcattgacttccacgtgttccaccgcaaagatagccgcaacgtgtttctgttcaaactgggtggggtcacggcctccttcactgcctccgtgggcagcctgttcctcacagccatcgacaggtacatatccattcacaggcccctggcctataagaggattgtcaccaggcccaaggccgtggtggcgttttgcctgatgtggaccatagccattgtgatcgccgtgctgcctctcctgggctggaactgcgagaaactgcaatctgtttgctcagacattttcccacacattgatgaaacctacctgatgttctggatcggggtcaccagcgtactgcttctgttcatcgtgtatgcgtacatgtatattctctggaaggctcacagccacgccgtccgcatgattcagcgtggcacccagaagagcatcatcatccacacgtctgaggatgggaaggtacaggtgacccggccagaccaagcccgcatggacattaggttagccaagaccctggtcctgatcctggtggtgttgatcatctgctggggccctctgcttgcaatcatggtgtatgatgtctttgggaagatgaacaagctcattaagacggtgtttgcattctgcagtatgctctgcctgctgaactccaccgtgaaccccatcatctatgctctgaggagtaaggacctgcgacacgctttccggagcatgtttccctcttgtgaaggcactgcgcagcctctggataacagcatgggggactcggactgcctgcacaaacacgcaaacaatgcagccagtgttcacagggccgcagaaagctgcatcaagagcacggtcaagattgccaaggtaaccatgtctgtgtccacagacacgtctgccgaggctctgtgagcctgatgcctccctggcagcacaggaaaagaatttttttttttaagctcaaaatctagaagagtctattgtctccttggttatatttttttaactttaccatgctcaatgaaaaggtgattgtcaccatgatcacttatcagtttgctaatgtttccatagtttaggtactcaaactccattctccaggggtttacagtgaagaaagcctgttgtttaagtgactgaacgatccttcaaagtctcaatgaaataggagggaaacctttggctacacaattggaagtctaagaacccatggaaaaatgccatcaaatgaataatgcctttgtaaccacaactttcactataatgtgaaatgtaactgtccgtagtatcagagatgtccatttttacaagttatagtactagagatattttgtaaaatgtattatgtcctgtgagatgtgtatcagtgtttatgtgctattaatatttgtttagttcagcaaaactgaaaggtagacttttatgagaacaatggacaagcagtggatacgtgtcaatgtgtgcactttttttctatattattgcccatgatataactttagaaataaaccttaatatttcttc

SEQ ID NO: 113965 - DNA, 5254 bp, Homo sapiens
  Payload ID: 2271
  Gene Symbol: CNR2
  Gene Name: cannabinoid receptor 2 (macrophage)
  Uniprot ID: P34972
  ENST ID: ENST00000374472
  CDS Start-End: 163-1245
ggcactcaacaggtgctctgagtggcacccacggccaggtcctgggagaggacagaaaacaactgggactcctcagcccccggcagctcccagtgcccagccacccacaacacaacccaaagccttctagacaagctcagtggaatctgaagggcccaccccatggaggaatgctgggtgacagagatagccaatggctccaaggatggcttggattccaaccctatgaaggattacatgatcctgagtggtccccagaagacagctgttgctgtgttgtgcactcttctgggcctgctaagtgccctggagaacgtggctgtgctctatctgatcctgtcctcccaccaactccgccggaagccctcatacctgttcattggcagcttggctggggctgacttcctggccagtgtggtctttgcatgcagctttgtgaatttccatgttttccatggtgtggattccaaggctgtcttcctgctgaagattggcagcgtgactatgaccttcacagcctctgtgggtagcctcctgctgaccgccattgaccgatacctctgcctgcgctatccaccttcctacaaagctctgctcacccgtggaagggcactggtgaccctgggcatcatgtgggtcctctcagcactagtctcctacctgcccctcatgggatggacttgctgtcccaggccctgctctgagcttttcccactgatccccaatgactacctgctgagctggctcctgttcatcgccttcctcttttccggaatcatctacacctatgggcatgttctctggaaggcccatcagcatgtggccagcttgtctggccaccaggacaggcaggtgccaggaatggcccgaatgaggctggatgtgaggttggccaagaccctagggctagtgttggctgtgctcctcatctgttggttcccagtgctggccctcatggcccacagcctggccactacgctcagtgaccaggtcaagaaggcctttgctttctgctccatgctgtgcctcatcaactccatggtcaaccctgtcatctatgctctacggagtggagagatccgctcctctgcccatcactgcctggctcactggaagaagtgtgtgaggggccttgggtcagaggcaaaagaagaagccccgagatcctcagtcaccgagacagaggctgatgggaaaatcactccgtggccagattccagagatctagacctctctgattgctgatgaggcctcttcccaatttaaacaactcaagtcagaaatcagttcactccctggaagagagagaggggtcttggcactctcttcttacttaaaccagtcccagacacctagacacggacccctttttgctgatgagtgttgggactgactcctggaagacagcctggccttgcccacctgcacacagtctgttggataggtagggccacgaggagtagccaggtaggcgagacacaaaaggcctgggacagggtcagtacaagtcaggtcaggcttcatgcctgcatcctccagagaccacaggagccaaagcgagcctccaggcccagcaatgagggacttgggagaaatctgagaagaatgggttgttctcttgggaagtcagggtatcagatgggatggacatccaggtcttctctctgcctaattgtcaaggcctccttggctctggagctatgaaaggccccactttcaagtcacccttgccactgaggaccgaggactatgctatgatgaggattaaggtgttgacttgcctctttcagagataaatgacaagccttcagtttggggcatcctgttgtttgggcgaggaccctctctgatattctgataatccccacctgtaacctcaggtccctggaaatacagaggaggctgggatcgcctgagacacaaaaatctttggagaattttcttgaccctctgaagtccttccagcagcagtcctggtggtgctgctggaagcaggcaatgtcctagtctaacctaactcgaagaaaaaaaggaagatattcacaaagattgtataaatctccaaactgttcccctatctgcccccaattcagctcccttgcctcctccacacccctattacatataataagcagagcaagtgggaggaggggaaatgtccttcctatatgccaggtatggggctgacatttcagtctattgaccccagctagaatatagctccatgattttaaagatctcaggggccaggcatggtagctcatgcctgtaatcccagcactttgggaggccaaggcaggtggatcacctgaggtcaggagtttgagaccagcctgaccaatatggtgaaaccctgtctctactaaaaatacaaaaattagcagggcatggtggcaggcacctgtagtcccagctactcgggaggctgagacaggagaattgcttgaaccctggaggcagaggttgcagtgagccgagattgcaccactgcactccagcctgggtgacagagcaagactgtctcaaaaaaataaaataaaatagatcccagggtactcatttttcatatgagggaggctgggttcctcccagaggagcctaaaacagccaacaagagaaattgttggcggcaggaagattgcagaggaattctaatgcaattatttgggacctcaaatggaataaaatgaaagatattggttaaacatgtcttcgtttaatactttcaagacaaaatatccactagctattcacttattcattcatctcataaacatgagccaggctctgtgcagggtcctgagtacccagccataaatgagactgtgcccctgtctcatggggcttacagtctatatcctgcttgcaagacagccaataagtcaataaagaagataattacaggcagtacaacaaaggaaatatgcaggttcatgtcatgtaatagggattaattgagttaactcaataaacggtaggatagacctaccatgtgccggctcacttttattgagcctttactatgtgccaggcagggggctaagtgtttttaaatgccttatttcacttcatgtttcccaacaacctaataagaaggtcttagttatcttcattttacagatgtggcaacctcaaagatgcaaagtcacttgtctaaggtcaccctgctaagtaccagagctgaggtctccaacctagttctgtttgacttcaaagcctgccctcttaaccactaaccttttgtcctagttcagtcaaattctgcttgattattgctcattagggataatattagctatctgtagcatcagattgctgcaaagttaactcatcgtagattctcaatatactccattttattaaatggccccgtattaatctcctgtaataaatttcacaaatccagtggcttatcaacagaaatttactgtctcataattctggaggccagaagtcaaaatcaagatgtggtagggccctgctccctccaaaagtttaaggggagaattattccttgactctttcaacttctggcagtccctgtcattccttggcttgtggaaacatcactcctacctctgactctgtcttcatatggcatttcctctgtgtctcttggtgtcttttttttttttttttttttttttgagacggaatctcattctgttgtccaggcaggagtgcagtgacatgatcttggctcactgcaacctccacctctcaggttcaagtgattctcctgcctcagcctcccaaatagctgggactacaggcacccgccaccacactcagctaatttttgtatttttagtagagatggggtttcaccatcttgcccaggctggtcttgaactcctgacctcaagtgatccgcccaccttggcctcctaaattgctgggattacagacgtgagccaccatacccggcctggtgtcttttttaaagaatatcagtcactggatttgggcccaccctaatcctaatagtatgacttcatcttaatttaaccaattatatctgtagagaccctgtttccaaataaggtcacattcacagattccaggtggacaagaagtttaggcggacactattcaactcagtacagacccaggaacaaagtccacccactgggctgtgttgagtggcagtcactagtttatcctccctcaacaagatgagctccaggttgacctctgcatccccagtgctcagtcaggacccagcagagcatctgaagggatctggtcaatatgtgtggaactgaactgtttctgaaaagctctgacgtatgttttggaaaatcaaatcttgttttaatccagacaccaatctttttgtaaggcaaacaagtagcataaatgtttaaaagtgaatttgcatgtttatatactgtcattccttaaagttgaagcatgcctttctttattcatcggtggaatcctttctcattttggcaaagaaaatgcccaagtgcctggcacaaacaagcactgagtaaatacttcttgaatgaataaaactagattctaaaaatcatttgatcaaacgcaactccacactttctacttctcttcttttagaaccacactgtatttctgctttttttttttttttttttttttttgacatagaatctcactctgtcacccaggttggagtgcagtggcatgcaatcttggctcactgcaacctctgcctcctgggttcaagcagttctcctgccttagcctcccatgtagctgggattacaggtacccgccaccatgcccagctaatttttgtattgttagtagagatggaatttcaccatattggccaggctggtcttgaactcctgacttcaagtgatccacccaccttagcctcccaaagtgctaggattacaggtgtgagccaccactcccagcccctatgtctgctttaagtggagaagcagagcttatgagggaggagaacaagggtgcaaaagggacctagatatcactgagaactgcccttgttgtttggttgaggaaatgggcccagacagtggacaagacttgctcagggagacaaacgagatggtgtccagtgcaacaaacctaggtttcctaacttccagttctgtccactctacatcagtgcctctcacctgtccctgcaggttcacattttggttatgtggataaggagaaataaattgaagatcacaatgtcccattttatcttccccaagacaagctctgtaacattaaagaccactatgcaaaccga

SEQ ID NO: 113966 - DNA, 1953 bp, Homo sapiens
  Payload ID: 2272
  Gene Symbol: CNRIP1
  Gene Name: cannabinoid receptor interacting protein 1
  Uniprot ID: Q96F85
  ENST ID: ENST00000263655
  CDS Start-End: 607-1101
tccctttaccccccctcagcctcctcccgcctggctggcgccggatccgcgagcagcagtgtccacctcacgtagctggccgaggcggtatccagattccgggggtctcgctccttggcatagtggtcgcttaactccagcgccttcccagtgcctcccaaacctctcctcctcctgcccggggctgttctaggaggagcctaaatgtccgcttccccagctgaaggggattgtggtgcgtaaacaggattaactccctcgcccccagctgcgcggatctgcgcggcggcctgcgggccagagcgagccttcgggtgcgtggagggcgcagcactggagcgggggatggggaagcgcgcggccttggagccgtctcttgggcccgcttcctcgccgagtggggaggggggccacagcctaaggagctgctcctcaaaagcccgggcggacggcggcgacggcgcgggttcctagcggcagcctcagctccaccacctccctcaccctccccgcgcttcctctccgcccctcgcgctccagccactcggccgcagccggcgctgtcctccgccccccggagccgccgcgccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccgttcacagacattgggaccttcgagacagtgtggcaagtcaagttctacaattaccacaagcgggatcactgccagtggggaagccccttctctgtcattgagtatgaatgcaagcccaacgagacacgcagtctgatgtgggtgaacaaggagtccttcctctgaaagtggctctttctgatgctactggacaatcttttcagaaatctacttttagataaaccagcgcaggccttaaacaaggcatgccacaccattgctgttccccatctggtactaatgacctactagccctggttattttgaaagtgtaattcccctctgacacaatatccctcacatacaagatggtgatgtaccactcccgagaatattcccatctgtattttgtgctgatgttcctgcatccagttgttctcggtcatacttttgaccacttgtgactggagttcagtggccctggcaggcttgtcctgctcttgaccattccactgactaactttggtgttttgtttccaagttaagtgattcctccttttttttgttcaatgttaaatttaaaaataacaatgtgtatgggtcctcccatgtgtaatatggtaacatgtaacttgcagtgtttgccagctttcaaagcaggctttgtgaaaatgtaatacaaacagcagtgaatgggactcaaatgttgtgcttcctataaacagctccgctctttcagggaaggatggtaacaaactagaaggacaaatatgtacgtatttataacgtattaaaactcttttaagtagcttaaggtattgtgcaatggcctagcctagtagaaatgggggaaaagcattgctgtggaccattgttaaagtgacaggagttgtagggttacccctttgacaagcttccatagtcttcagacacgcacattgatggcatccctacagtcttcttcacttgaactttgtaaaactgcatatggacctgtaatcaacttttgatatttcttaataaaggcgttgaaaatca

SEQ ID NO: 113967 - DNA, 1748 bp, Homo sapiens
  Payload ID: 2272
  Gene Symbol: CNRIP1
  Gene Name: cannabinoid receptor interacting protein 1
  ENST ID: ENST00000409862
  CDS Start-End: 183-596
atagtggtcgcttaactccagcgccttcccagtgcctcccaaacctctcctcctcctgcccggggctgttctaggaggagcctaaatgtccgcttccccagctgaaggggattgtgccactcggccgcagccggcgctgtcctccgccccccggagccgccgcgccagaccctcgcccagacatgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccggtaaggcttgcttgcgggtataggagtatggtgccatggaaaatggaaaccacagaaaagaaaacaatcactatctctctgtaagaaaaggtgtgttgggagccaattactgtggaaattgagttgtggatttccttcaagcatctgctggagagagaactacttaattaatgctcttttgcatgacagactgaccctgtagatgctgaaaagacaccataagcagaagcagatggttctggaagagacagaacctacattgccattttcccagttatagtctacttcagaactggtttagataattggctgtgaaaagtttctgattccaagtaggccacaatattctggttaagagaaagctgatttgaatgacactttgctacttaaagctaaatggaggagccaaaaaaagtgtcatgggaaaaatacacctcttatataatatcctataatacacctattttatataatatatacctattatatatacacctatataatatatatatacctatattatatatacctattatatataatatctggtaatcctatcagatatcatatataataaaatgatataccctggtaatatggccccaagtaagaaaaaacaaattggtagaaaggatagagtcaagacatagatttaactatatgtgcaaacataataaataggtgatgaagcaagcttgctaaagcacaggaaaaggaagcttcacctaaactgctgcttgcaaactgggcagccttttccctctgcaagaacaaccttcaactgtctgccctctagctttataggaagtatcacaagggttctcaaatatcggtatgcgtgagaatctctttgggagtttgtttaaaattccagtcctaggttccctctccagtgatcttagctcagtagagctagggtggggacagagaaactcttagcaagcataccagatcctgaagaggatggtgtgggaatgcactttgagaaatgcctatctaacctttggaaacttaaagtgttcccagtccccattatactttttaaaaccacaatagtcacataaggaaataatctagcagctcatccctttgcatccaatgtttgaactatttttagaaagtgctcttgttctgtcaaagaaccttcaacacagaaaaatacaaaaatgagggaaatgtataattcctgcaagagagaagtgttgttaacatgtcaataaatgttcttagaaagtt

SEQ ID NO: 113968 - DNA, 644 bp, Homo sapiens
  Payload ID: 2272
  Gene Symbol: CNRIP1
  Gene Name: cannabinoid receptor interacting protein 1
  Uniprot ID: Q96F85
  ENST ID: ENST00000409559
  CDS Start-End: 1-387
atgggggacctgccgggcctcgtgcgcctctccatcgcgctgcgcatccagcctaatgacggcccggtcttttacaaggtggacgggcagcgcttcggccagaaccgcaccatcaagctgctcaccggctcctcctacaaggttgaggtgaagattaaacccagcacgctgcaggtcgagaatatttccattggtggtgtgcttgtcccactggaactgaagtctaaagagcctgatggggacagagttgtttatacgggtacatatgacacagaaggtgtgaccccaacgaagagtggagaacggcaacccatccagatcaccatgccggagtgcctggaacaacgaccccaagagatctctcttacatatgaatgtgaagaataagcacattcttcaatgtgtgccatcatgaggaacaaatgttcttttttttttttccaaattatttgctttgcattctaggggagggcttctcacaggccatcagaattatcggggatgcttgttaaaatgtagattcctaaactctacctttttagacctcttaaattgagcaaactctctgagagtaaatccaaagcatctgcattttattaagcactttaggtgattcttatcatattaaagtttggaaaacacta

SEQ ID NO: 113969 - DNA, 2378 bp, Homo sapiens
  Payload ID: 2273
  Gene Symbol: CNPY1
  Gene Name: canopy FGF signaling regulator 1
  Uniprot ID: Q3B7I2
  ENST ID: ENST00000321736
  CDS Start-End: 164-442
aatcctcttggtgggtgctgaaacaatgccgggagagcaaagccgctgagagtttgtcccgttagatccaggcgtgaaggacggactgtactacagggagcagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcagatctgtgtgaaacttctgctaatcatactgagctctaggagtgccgttctgctggtcgtagagaggagtaaagtcacacccaaaggtcaatgtctgcattttatgtttgcatgttgtctttcatgataagaaaaattttgtctcttgtttataccgtgtttgtctccgtttatgattcattttgaaaatctgttggttgacatcatgacaaaccctgcgtttttttataggtgaagctgaggagtacatgaaacttaaattaacctttgcagattttgataaatcaagcttgacaatagaggatttaattctgtattgaggaaaaaagcgaagacatttcataaacaaaatagggatttcataatgtatgctgcttattttataacagtgtatgtgcacatatgcaagcgcagtggctgtctgataagaactggatttgaatcctcaaatacttgattgcctataaatttaaggaaatacatggcaacaaattcaaaatgtggccttctgggtgagatatggctattagtgaaagaaacccactttttatcaggaatgaaattaaaatttttagaaaccacaagtttaaaaacccatctctaaaatttagtggaatgtgtaaaaactaatgaatgctttaatttatagtaaacaataattatattggcctctcaaacaccattctgagtttaagtggcttagaaagttgatttattattgcatcaggtgttaaaagatgacactagtgattgcgttttgtttcgctccaaactcttctggcttgtttgtttttcttctaaacgttttttttttggctcacatttagtgtgttgagtttactactaaataatctaccattcttctacaggaatggaaaaagagttgggacctggtgggaaattatcttttggccacacttaatatacaaagtctagtaacaatcactcccggaaatttctttatctctgttacatttgcattcaatggaatctgactttaatgattaaaaatgtcagggtatggtctacaccagtttctaaaaagagattctcattgtctttggtgacaatcaagtgggtaggatgctacaaatcccccccccaacccccccgacccaaaactctttgccatattgttacttagttgcttaaaaagcacattatgtgtttaaatcattctcctgactcttcagcaggaaacaattcttaaatttaggaaaatttaccaaagctaaggggaagggctttccatgccccctccccacctaaactctgattaaaagttagtgagttaatgtcacttaattacttgggtgcttcttttttgtcttgtctgtggctgcttaagtctgatggctcctacataacccagcgaactcgcacccgagctgacacacgatggaaatagaactgaataataattaacactattttccagtagggtaggacaattgttatttaaaacatagtccctatagctttatttaaacgtatctagttaaggttaatttggcatttaaagtagtaaatcaggaacattctcctaacttggattttcttgggaaatgcactaaacaggacaattattcctgaaaacctagtgaccttcacaggaacatggcgggacctgtgacactaagtaagcttcagtgaaaactgttcacggtcgtaaccgtagaagtgttgccaaatctgtttccatactctctttgatcatcatcaaacattctcaaatgtaggcaatgctaacactaattatagaaattaagaaaatgtgggctcctgtttgtaactaaacggacgtggggaggtgcacctcctgtcactgaggggtgcctttcatggacagtgatgctttgctttgaatggagagggcgaggaaccttgacttacagtgactatctaaggttgtgataaatatggcatttcaggtttttttcttggatttcccattaaaaatagtcttgtatcttgc

SEQ ID NO: 113970 - DNA, 560 bp, Homo sapiens
  Payload ID: 2273
  Gene Symbol: CNPY1
  Gene Name: canopy FGF signaling regulator 1
  Uniprot ID: Q3B7I2
  ENST ID: ENST00000406197
  CDS Start-End: 140-418
aatgccgggagagcaaagccgctgagagtttgtcccgttagatccaggcgtgaaggacggactgtactacagggagcagatccccctagctcagtcggaggcgttcctaacggatcttttggagaaagtctgtgagcgaatgaacgactacaagcttgaggaagaccctgtgacgaaggagagaactttcaagagattcgctcctaggaaaggagacaaaatataccaagaatttaaaaaattgtatttttattctgatgcttacagacctttgaaatttgcgtgtgaaactataatagaagagtatgaagatgaaatatcctcacttatcgcccaggagacacactatctagctgacaagctgtgcagtgaaaaatcagatctgtgtgaaacttctgctaatcatactgagctctaggagtgccgttctgctggtcgtagagaggagtaaagtcacacccaaaggtttcagatgaggaaaccaaggcccagagaggaaaaggcacagcaggcatgacaccagtgccatcggtgtttgcttcacccttgcagattacgag

SEQ ID NO: 113971 - DNA, 1214 bp, Homo sapiens
  Payload ID: 2274
  Gene Symbol: CNPY2
  Gene Name: canopy FGF signaling regulator 2
  Uniprot ID: Q9Y2B0
  ENST ID: ENST00000273308
  CDS Start-End: 542-1090
ctggactgctcgctggccggcagcgcaccgttttgaaggtcctagcccacctgggctggctcacgcgcacgactagccgctcccatacagcacgcccggactctgtcgtcgcttaaggccactcctattctacggctgacccctggtggtcacgtggatctgttcgccacgcaagtctgggtccttcggcgattgaccggggtccttgctgttcgggagcctctcctaagctgcctgttcgcgcgagagtttggaggggcgggtttggggtcggtgtctgattggggctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtgtagtttcgggagccactggggccaaagtgagagtccagcggtcttccagcgcttgggccacggcggcggccctgggagcagaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtacaaa

SEQ ID NO: 113972 - DNA, 484 bp, Homo sapiens
  Payload ID: 2274
  Gene Symbol: CNPY2
  Gene Name: canopy FGF signaling regulator 2
  ENST ID: ENST00000551286
  CDS Start-End: 179-484
gacagccctgctccctgcagccaggtgtagtttcgggagccactggggccaaagtgagagtccagcggtcttccagcgcttgggccacggcggcggccctgggagcagagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccga

SEQ ID NO: 113973 - DNA, 673 bp, Homo sapiens
  Payload ID: 2274
  Gene Symbol: CNPY2
  Gene Name: canopy FGF signaling regulator 2
  ENST ID: ENST00000546466
  CDS Start-End: 1-243
aagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagtacaaactgtgttgtcttttcatgcctggaattgcccttacattaagcttgaagataaggagttatatagacaggaaagataatggaggagaaagaagagttttgggattgatacaggataaagatggagggaccagcaagaacagagacaggaaggggaaaatggatgtgaccaactcagctgaaaagtaagggctttatcggatagggacagacgaggtaaggaaggttgtttaatgagaggccttgcttgccagcctaagcttttaaatttgatgccagtggcaacaataaagtgtatctatcactagc

SEQ ID NO: 113974 - DNA, 674 bp, Homo sapiens
  Payload ID: 2274
  Gene Symbol: CNPY2
  Gene Name: canopy FGF signaling regulator 2
  ENST ID: ENST00000551475
  CDS Start-End: 170-674
gctcgcaccgcagcacgctggagtcccgcttaggtaccagttagcgtcaggggagctgggtcaggcggtcgccgggacaccccgtgtgtggcaggcggcgaagcgctctggagaatcccggacagccctgctccctgcagccaggtggagcgaccccattacgctaaagatgaaaggctggggttggctggccctgcttctgggggccctgctgggaaccgcctgggctcggaggagccaggatctccactgtggagcatgcagggctctggtggatgaactagaatgggaaattgcccaggtggaccccaagaagaccattcagatgggatctttccggatcaatccagatggcagccagtcagtggtggaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacag

SEQ ID NO: 113975 - DNA, 621 bp, Homo sapiens
  Payload ID: 2274
  Gene Symbol: CNPY2
  Gene Name: canopy FGF signaling regulator 2
  ENST ID: ENST00000553191
  CDS Start-End: 1-124
agcatgcagggctctggtggatgaactagaatgggaaattgcccaggtggaccccaagaagaccattcagatgggatctttccggatcaatccagatggcagccagtcagtggtggagaggtagaagagagtgacccaaggctgaggacatttctaggtgccttatgcccgctcagaggcccacctcacagagctgctggaggagatatgtgaccggatgaaggagtatggggaacagattgatccttccacccatcgcaagaactacgtacgtgtagtgggccggaatggagaatccagtgaactggacctacaaggcatccgaatcgactcagatattagcggcaccctcaagtttgcgtgtgagagcattgtggaggaatacgaggatgaactcattgaattcttttcccgagaggctgacaatgttaaagacaaactttgcagtaagcgaacagatctttgtgaccatgccctgcacatatcgcatgatgagctatgaaccactggagcagcccacactggcttgatggatcacccccaggaggggaaaatggtggcaatgccttttatatattatgtttttactgaaattaactgaaaaaatatgaaaccaaaagt

SEQ ID NO: 113976 - DNA, 1704 bp, Homo sapiens
  Payload ID: 2275
  Gene Symbol: CNPY3
  Gene Name: canopy FGF signaling regulator 3
  Uniprot ID: Q9BT09
  ENST ID: ENST00000372836
  CDS Start-End: 372-1208
gcaggcttcttctcgggtcttggtcctgcatcctctctctcccagagcctccgttagggggtgggaaaggactttgccataggtcgctgaggccaccatctgctctcttactggccaagggcgtaaaaagatagtcttcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctggattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattcctctgcgccaaccacgtgctgaagggaaaagacaccagttgcctggcagagcagtggtccggcaagaagggagacacagctgccctgggagggaagaagtccaagaagaagagcagcagggccaaggcagcaggcggcaggagtagcagcagcaaacaaaggaaggagctgggtggccttgagggagaccccagccccgaggaggatgagggcatccagaaggcatcccctctcacacacagcccccctgatgagctctgagcccacccagcatcctctgtcctgagacccctgattttgaagctgaggagtcaggggcatggctctggcaggccgggatggccccgcagccttcagcccctccttgccttggctgtgccctcttctgccaaggaaagacacaagccccaggaagaactcagagccgtcatgggtagcccacgccgtcctttcccctccccaagtgtttctctcctgacccagggttcaggcaggccttgtggtttcaggactgcaaggactccagtgtgaactcaggaggggcaggtgtcagaactgggcaccaggactggagccccctccggagaccaaactcaccatccctcagtcctccccaacagggtactaggactgcagccccctgtagctcctctctgcttacccctcctgtggacaccttgcactctgcctggcccttcccagagcccaaagagtaaaaatgttctggttctgatttctgagtcctctgcagccctca

SEQ ID NO: 113977 - DNA, 954 bp, Homo sapiens
  Payload ID: 2275
  Gene Symbol: CNPY3
  Gene Name: canopy FGF signaling regulator 3
  ENST ID: ENST00000394142
  CDS Start-End: 380-811
gcccagacgcaggcttcttctcgggtcttggtcctgcatcctctctctcccagagcctccgttagggggtgggaaaggactttgccataggtcgctgaggccaccatctgctctcttactggccaagggcgtaaaaagatagtcttcccattagctagagagcaaaccccagaaagcctattggctgcgccgtccgcgggccttggtccgctttgaaggcgggctgcggctgcgagaggagggcgggcgggaggctagctgttgtcgtggttgctcggaggcacgtgtgcagtcccggaagcggcgaggggaaactgctccgcgcgcgccgcgggaggaggaaccgcccggtcctttagggtccgggcccggccgggccatggattcaatgcctgagcccgcgtcccgctgtcttctgcttcttcccttgctgctgctgctgctgctgctgctgccggccccggagctgggcccgagccaggccggagctgaggagaacgactgggttcgcctgcccagcaaatgcgaagtgtgtaaatatgttgctgtggagctgaagtcagcctttgaggaaaccggcaagaccaaggaggtgattggcacgggctatggcatcctggaccagaaggcctctggagtcaaatacaccaagtcggacttgcggttaatcgaagtcactgagaccatttgcaagaggctcctgattatagcctgcacaaggagaggaccggcagcaatcgatttgccaagggcatgtcagagacctttgagacattacacaacctggtacacaaaggggtcaaggtggtgatggacatcccctatgagctgtggaacgagacttctgcagaggtggctgacctcaagaagcagtgtgatgtgctggtggaagagtttgaggaggtgatcgaggactggtacaggaaccaccaggaggaagacctgactgaattc

SEQ ID NO: 113978 - DNA, 1502 bp, Homo sapiens
  Payload ID: 2276
  Gene Symbol: CNPY4
  Gene Name: canopy FGF signaling regulator 4
  Uniprot ID: Q8N129
  ENST ID: ENST00000262932
  CDS Start-End: 133-879
tgatcctgcgcatgcgccgaccttcctcggctggatttaaggttgccgctagccgcctgggaatttaagggacccacactaccttcccgaagttgaaggcaagcggtgattgtttgtagacggcgctttgtcatgggacctgtgcggttgggaatattgcttttcctttttttggccgtgcacgaggcttgggctgggatgttgaaggaggaggacgatgacacagaacgcttgcccagcaaatgcgaagtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccacccccacccaaaagtcagcagtggcactggagctgtgggctttggggaagtcacttagctccttaaggtctgtttttagacccttccaaggaagaggccagaacggacattctctgcgatctatatacattgcctgtatccaggaggctacacaccagcaaaccgtgaaggagaatgggacactgggtcatggcctggagttgctgataatttaggtgggatagatacttggtctacttaagctcaatgtaacccagagcccaccatatagttttataggtgctcaattttctatatcgctattaaacttttttctttttttctaaaaacta

SEQ ID NO: 113979 - DNA, 721 bp, Homo sapiens
  Payload ID: 2276
  Gene Symbol: CNPY4
  Gene Name: canopy FGF signaling regulator 4
  ENST ID: ENST00000483756
  CDS Start-End: 614-721
tgtagtgccacctcaaactgcatccagagagagcctgcatttttttggctggcttggaaccccccgcccgccaatggattgtgggaattgtagttcagggaccatcggcccgggactgccaacttttagagcatcttcagtgagtgtttacctcatgtcaccagaccttaatctgcagaggctgcaggagccgggtgtgaggctcaggccttgtggacatccgctgccctaccctagcatagacgctcccaaattacaggccccacaccccgctgagggggtttgagggtgagtaattcagcctttgaagctcataaacaaaaggaagccacacaactaggagagtgtccccatccggtgagactttgcagacgtgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcag

SEQ ID NO: 113980 - DNA, 1003 bp, Homo sapiens
  Payload ID: 2276
  Gene Symbol: CNPY4
  Gene Name: canopy FGF signaling regulator 4
  ENST ID: ENST00000462193
  CDS Start-End: 1-356
tgtgtaagctgctgagcacagagctacaggcggaactgagtcgcaccggtcgatctcgagaggtgctggagctggggcaggtgctggatacaggcaagaggaagagacacgtgccttacagcgtttcagagacaaggctggaagaggccttagagaatttatgtgagcggatcctggactatagtgttcacgctgagcgcaagggctcactgagatatgccaagggtcagagtcagaccatggcaacactgaaaggcctagtgcagaagggggtgaaggtggatctggggatccctctggagctttgggatgagcccagcgtggaggtcacatacctcaagaagcagtcaggttgagcagggagagaagacaggcgggatcccaaatccctccagagcagatactcttctggcccttctacttgaccagtgtgagaccatgttggaggagtttgaagacattgtgggagactggtacttccaccatcaggagcagcccctacaaaattttctctgtgaaggtcatgtgctcccagctgctgaaactgcatgtctacaggaaacttggactggaaaggagatcacagatggggaagagaaaacagaaggggaggaagagcaggaggaggaggaggaagaggaggaagaggaagggggagacaagatgaccaagacaggaagccaccccaaacttgaccgagaagatctttgacccttgcctttgagcccccaggaggggaagggatcatggagagccctctaaagcctgcactctccctgctccacagctttcagggtgtgtttatgagtgactccacccaagcttgtagctgttctctcccatctaacctcaggcaagatcctggtgaaacagcatgacatggcttctggggtggagggtgggggtggaggtcctgctcctagagatgaactctatccagccccttaattggcaggtgtatgtgctgacagtactgaaagctttcctctttaactgatcccac

SEQ ID NO: 113981 - DNA, 4033 bp, Homo sapiens
  Payload ID: 2277
  Gene Symbol: CMTR1
  Gene Name: cap methyltransferase 1
  Uniprot ID: Q8N1G2
  ENST ID: ENST00000373451
  CDS Start-End: 165-2672
cgcagtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagagcgtgtttgatgtcttggatggggaagagatgcggcgagctcggactcgggccaatccctatgagatgatccgaggagtcttctttctaaacagggcagcaatgaagatggctaacatggattttgtatttgatcgcatgttcacaaatccgcgggactcttatgggaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgtctcttcaagcctattaccagccgtcctgccaactcagagaggtatgtggtgtgcaagggcctgaaggtgggcatagatgatgttcgggattacctcttcgcagtgaatattaaactcaatcagctgcggaacacggattccgacgtcaacttggtggtccccctggaggtgatcaagggagaccatgaatttactgactacatgatacggtccaatgagagccactgtagtctgcagatcaaagctctggcgaaaatccatgcctttgttcaagacacgacactgagtgagcctcgacaggcagagatacggaaggagtgcctccgactctgggggatcccagaccaggctcgtgtggctccttcttcctccgaccctaaatcgaagttctttgagctaatccagggcactgagattgacatcttcagctacaagcccacactgctcacctctaaaaccctggagaagatccgccctgtgtttgactaccgctgcatggtatctggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacatttgctactatggccggctcttctgggagtggggggatggcattcgtgtgcatgactcccagaagccccaggaccaggacaagctgtccaaggaggacgtcctctccttcatccagatgcacagggcctaagagcctcagaatgtgccacccctgcagaatgccctgtcattcctgagatggggccacctggggcccacagtgctggcttcttccccctcttgaaaagggactggggagcattgcacctggcatgaggagtgggtggcctcctctccatcccctgaagagctcaggcagggccctgcagagaacactcatgttccttctgggacacctgcctgggaactttcccctgccaggactcagcctgaaggaagctgctcctgaggcaggtatgaggtcagtgcctagggcacgtgggactgatggaggacatatcagagtggcagagctgtgggctctgctgttctctcctgcatcctgtagactcacttttctgagttccatgcactgccctgagggtagccatgcccttgctttgcccaactttttattgggccatccctgagtgggtggagacctgctgtcatgagctggccaggagaacctgctataaaaaaatcaaggttttgtttctttgaacttactctgttttgatgccaaattggagaccattttcttgtctccttcccccactcatcctggccttccctggagttcttcctagcccagagctctgacagtccagcagggtgggaaggagggagtttgggcaaactctcatccctgataccacattgagatcctgggagccctcttttcgtactgagtatggagttgtagagccatcctaggtgccatccccttttggtccaaacattgggcagcgctagatggcaggaagcagccttgaagacccgtctttcccccacagcagcaggggccccagcagtaacaaagggtacctccaggggtttgggtagcgctgccctctggcagtcatgcaccgctgtctgccatagccgctctagggtcttggcagaattctgagcttgaagtgcagctcccttactaccctttcccttcctttttcttccctaataggaggtacaatctgcttttgtttgtcgttaagtggtcactcccatttcctttatcttggccgacaacacagagaggagggggagctgggcagtagcttggggtgggggtgggcacctgtggttgtttttaatgggaaatacctctcagagatgttcatgcaggctccctagggccccatcccagtgccaggctggtttccatggagatagggcactgaggctcccgtgaggttggaatcgacttcaccatgggggtccttcagccagcatccagctccccacccccaggctggcagtagcactgctgagatgctgtatttccacccaattctgggtatatcagtgtgtcttgcagaatcttggatcattaaagataaacatattttt

SEQ ID NO: 113982 - DNA, 769 bp, Homo sapiens
  Payload ID: 2277
  Gene Symbol: CMTR1
  Gene Name: cap methyltransferase 1
  ENST ID: ENST00000457419
  CDS Start-End: 1-470
aggggaaggcccagaggaagatcagtgccatccacatcctcgatgtccttgtgctgaatggcaccgacgttcgggagcagcactttaaccagcgaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttctacaacaagaaaaccaaggactctacttttgacctccctgcagactccattgccccatttcacctccccagccttgcctgcctgtcgaagatggattaactccgcactcccctgggatcgccacatgaccacttcaagtccccaagccgcccttcgctgcacagactgcatttttttctgccataattacaagcaatggcactgactggagggcatgacagtgtgtggtggggggatggacaggtggcacaatgtctgctgctcaaccccagcagtgcccgagccctggaagtaactcccactatttggcttggaaagtgcttcccactgtctccttcccactcgagctgggggccttctcctctattctgaattgtaatccagagctttcccttgaa

SEQ ID NO: 113983 - DNA, 1280 bp, Homo sapiens
  Payload ID: 2277
  Gene Symbol: CMTR1
  Gene Name: cap methyltransferase 1
  ENST ID: ENST00000455891
  CDS Start-End: 165-1280
cgcagtactggacccgagcgcgacggtgcggctggcggacccgggctggcttgtggggaaacgaaactgagggaggaggcggcggctctggcagcggcggcgacagtgtcggcctgaccccccctccgctccccggcagctcgctctctcccctcagcttaacgatgaagaggagaactgacccagaatgcactgcccccatcaagaaacagaaaaaaagagttgcagagcttgccctgagcctcagctccacgtccgatgatgaacctccctcctctgtcagtcatggagcaaaagcatctactacaagccttagtgggtctgatagtgagaccgaggggaaacaacacagctctgactcttttgacgatgcattcaaagcagactctcttgtggaaggaacttcttctcgctattccatgtataatagcgtctcccagaagcttatggccaagatgggcttcagggaaggtgaaggattgggtaaatacagccagggtcggaaggacatcgttgaggcttccagtcagaaaggtcgaagaggcttgggtctgacactccggggctttgaccaggagctgaacgtggactggcgagatgagccagagcccagtgcttgtgagcaggtgtcatggtttccagaatgtaccactgaaattcctgacactcaggaaatgagcgattggatggtggtgggaaagagaaagatgattattgaagatgaaacagagttttgtggggaagagctgcttcacagtgtgttgcagtgtaagaagccactggtgaaggaccgggaagctgagcttctgtactttgctgatgtctgcgcaggcccaggtggcttctcagagtatgtgctgtggaggaagaagtggcatgcaaagggctttggaatgactttgaagggccctaatgacttcaagctggaggacttctactctgcttccagtgaactcttcgaaccctactatggtgagggtgggattgatggagatggagatatcacccgcccagagaacatctctgcttttcggaattttgtcctggataacacagatcgcaagggtgtccattttctgatggctgatgggggtttctcggtggaggggcaggagaacctgcaggagatcctcagcaagcagctgcttctgtgtcagttcctcatggcgctgtccattgtccggacaggaggccacttcatctgtaaaacctttgacctgttcacaccgtttagtgtggggcttgtctacctgctgtactgctgctttgaacgagtttgt

SEQ ID NO: 113984 - DNA, 1032 bp, Homo sapiens
  Payload ID: 2277
  Gene Symbol: CMTR1
  Gene Name: cap methyltransferase 1
  ENST ID: ENST00000475364
  CDS Start-End: 1-340
tggcagtgagcagaagttcctcatcggcctggggaaatcccagatctacacatgggatggccgccagtcagaccgctggatcaagctagacctgaagacagagctgccccgggacactctgctatctgtggaaattgtgcatgagctgaaaggggaggggaaggcccagaggaagatcagtgccatccacatcctcgatgtccttgtgctgaatggcaccgacgttcgggagcagcactttaaccagcggtctgacctgggccccagggtagggagggtgggggtaggccagggcagcttgggaggacagcggcctcccgaggtgtggccccttatctaggccttctctgcttgttgacatcctgagagtttccccctcccacccactgactggtcccaaagtcagggtgagaattggagttgccacttcagagtttgctagggcttgggccctggttatcagagataccagcacactccattttgccacagctgctcaggttgaggtatttatgttaaggttgagcaagagggtgaccttgcgggtagagggggtactccttggaagaaatatcctgtgcttgagtggtcccatttaagttgctcatctgagtgggtgcactgtagtttccatgctttggggtgacagggcagacacatacaataaagatgatacttgaagttctagtggaggtgactgagcacagctgaaggcacacttcaggaaaaccaaccgacatagtgaaattagagaattcagcttgccgagaaatttgtgaaagccgtttccaagcctagtcggcccgacatgaatcccatcagggtgaaggaggtgtacagactggaagagatggagaagatttttgtcaggttggagatgaagatcatcaagggctccagtggcaccccaaagctcagctacacagggcgtgatgaccggcactttgtacccatgggcctctacatcgtcaggacagtgaatgagccctggactatgggattcagcaaaagcttcaagaagaagttcttcta

SEQ ID NO: 113985 - DNA, 4869 bp, Homo sapiens
  Payload ID: 2278
  Gene Symbol: CMTR2
  Gene Name: cap methyltransferase 2
  Uniprot ID: Q8IYT2
  ENST ID: ENST00000338099
  CDS Start-End: 338-2650
ggacggagccaaagaatgctccgcctgcgcgcgccgcttccgttgccatagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaaataattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagagattttgtgttcatcttttttaaatggaattatgggagaagttaaaaatataagttggaaacagacatttttaaagggagttttgaatgatagttaatgttctttcattttctctgatttgcattcattaaaatttagtccttaatattgtaatacttatggaaggcctacttcaggaaagaaattgaatacttaagggggattggaagaggagtgtgtggaggcctggaagtagatttttgaaagaaatctgatttcctactggtgactctatggaagcaattccagttgtatgacgatggaagtctgacagaaggttgattaccaggaggaaaaaaaaaaacactcttggaaaaccattttgcacttaatagtctttatgccttgctaagtgggattcaatatactaataatgcagcttattttttacttattttaactatttgataagaatgaagttgaaggcatgggtccagattctagcattattactgtctttaagcccttcaaataagtattgaatgcttagtgttttgttgacactaatctgtactggaatatataacactgaagtattctcaaatgtattttgctttttaacgtgggttttggaatcaattgctcatctgattcattggattcaaattgctttagaggttagacatgacttgaggaaggttcagattgaactggatatattaatagatgacaggtactaatgatttatatgagtttctctttaagagaaaggagaggaaaaatgctattcaaaagatgaatggaaaagtagaagaagacaggaagaggtgagagtatgcatgttttaccaaggtagactgttcttaaaaacttttttccacaggttttgagatttttaatttgtaatatctattaaaaaacaaacatcaaattg

SEQ ID NO: 113986 - DNA, 4104 bp, Homo sapiens
  Payload ID: 2278
  Gene Symbol: CMTR2
  Gene Name: cap methyltransferase 2
  Uniprot ID: Q8IYT2
  ENST ID: ENST00000434935
  CDS Start-End: 484-2796
ggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaaataattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcacaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagagaga

SEQ ID NO: 113987 - DNA, 476 bp, Homo sapiens
  Payload ID: 2278
  Gene Symbol: CMTR2
  Gene Name: cap methyltransferase 2
  ENST ID: ENST00000567610
  CDS Start-End: 161-476
gaaaatttttccacacacgctgtaagccacatgcttttttttttttttttaagtcatgcatttaagtgctggagtgaagttgaggtgcactattaatgactcatattcagaacctgaagagagagatcccttttgtgctaaattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctg

SEQ ID NO: 113988 - DNA, 565 bp, Homo sapiens
  Payload ID: 2278
  Gene Symbol: CMTR2
  Gene Name: cap methyltransferase 2
  ENST ID: ENST00000564183
  CDS Start-End: 90-565
acaaagctcaaaggactgtttaatgaaaggctcagaggatcatatactggaaaatttttccacacacgctattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaa

SEQ ID NO: 113989 - DNA, 695 bp, Homo sapiens
  Payload ID: 2278
  Gene Symbol: CMTR2
  Gene Name: cap methyltransferase 2
  ENST ID: ENST00000565850
  CDS Start-End: 299-695
gcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagctt

SEQ ID NO: 113990 - DNA, 587 bp, Homo sapiens
  Payload ID: 2278
  Gene Symbol: CMTR2
  Gene Name: cap methyltransferase 2
  ENST ID: ENST00000563876
  CDS Start-End: 109-587
gagcggaaccagcacgtcctgacagacagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatc

SEQ ID NO: 113991 - DNA, 632 bp, Homo sapiens
  Payload ID: 2278
  Gene Symbol: CMTR2
  Gene Name: cap methyltransferase 2
  ENST ID: ENST00000568910
  CDS Start-End: 362-632
acagggcgcgtgcgcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaaggtaatccaggcctgggtacgattccgggccctccttcgacttcccagcggattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctt

SEQ ID NO: 113992 - DNA, 1475 bp, Homo sapiens
  Payload ID: 2278
  Gene Symbol: CMTR2
  Gene Name: cap methyltransferase 2
  ENST ID: ENST00000614452
  CDS Start-End: 446-1468
agggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaacttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaatttgggactgaaatgaaaaggaa

SEQ ID NO: 113993 - DNA, 4168 bp, Homo sapiens
  Payload ID: 2278
  Gene Symbol: CMTR2
  Gene Name: Cap methyltransferase 2
  ENST ID: ENST00000634752
  CDS Start-End: 551-2863
cggagccaaagaatgctccgcctgcgcgcgccgcttccgttgccgtagtggccgggggcgggaggctggcgcctcccagcttctgtactccgcgaagcaaaacctagggagctgaggcctaggcgaggcgagagtcgccggcgtgcgtaacgttggcgcacgtgactccggcccggcctacagggcgcgtgcgcagtgggacttgagtgcctcctggtccctgtctgccggcattcgcggctgcggggcccggaggtgggactggcttcccggtgccgcgagggcgggtccggacagccttccccccagtccggcgcaccatctccctgccttgtggctggaggcgccgcggacccaaagggagggaccatcccgggaagcagccccgagagcggaagtgcagaatggcttcctcgagagagtaaagtgcagcctctccagacactggggccccagtgggcgtgggcgaagttgctggtaggaggagttggcggaagcacttggaactcctttataagtgtcagctgtgagattttaatttgatttgaaaatgagtaagtgcagaaagacaccagttcagcagctagcaagtcccgcgtcattcagcccagatattcttgctgacatttttgaactctttgccaagaacttttcttatggcaagccacttaataatgagtggcagttaccagatcccagtgagattttcacctgtgaccacactgaatttaatgcatttcttgatttgaagaactccctaaatgaagtaaaaaacctactgagtgataagaaactggatgagtggcatgagcacactgctttcactaataaagcggggaaaatcatttctcatgttagaaaatctgtgaatgctgaactttgtactcaagcatggtgtaagttccatgagattttgtgcagctttccacttattccacaggaagcttttcagaatggaaaactgaattctctacacctttgtgaagctccaggagcttttatagctagtctcaaccactacttaaaatcccatcggtttccttgtcattggagttgggtagcgaatactctgaatccataccatgaagcaaatgacgacctcatgatgattatggatgaccggcttattgcaaataccttgcactggtggtactttggtccagataacactggtgatatcatgaccctgaaattcttgactggacttcagaatttcataagcagcatggctactgttcacttggtcactgcagatgggagttttgattgccaaggaaacccaggtgaacaagaagctttagtttcttctttgcattactgtgaagttgtcactgctctgaccactcttggaaacggtggctcttttgttctaaagatgtttactatgtttgaacattgttccataaacttgatgtacctgctaaactgttgttttgaccaagtccatgttttcaaacctgctactagcaaggcaggaaactccgaagtctatgtggtttgcctccactataaggggagagaggccatccatcctctgttatctaagatgaccttgaattttgggactgaaatgaaaaggaaagccctttttccccatcatgtgattcctgattcttttcttaagagacatgaagaatgttgtgtgttctttcataaatatcagctagagactatttctgaaaacattcgtctatttgagtgcatgggaaaggcggaacaagaaaagctgaataatttaagggattgtgctatacaatattttatgcaaaaatttcaactgaaacatctttccagaaataattggctagtaaaaaaatctagtattggttgtagtacaaatacaaaatggtttgggcagaggaacaaatattttaaaacttataatgaaaggaagatgctagaagccctttcatggaaagataaagtagccaaaggatactttaatagttgggctgaagaacatggtgtatatcatcctgggcagagttctattttagaaggaacagcttccaatcttgagtgtcacttatggcatattttggagggaaagaaactgccaaaggtaaaatgttctcctttttgcaatggtgaaattttaaaaactcttaatgaagcaattgaaaagtcattaggaggagcttttaatttggattccaagtttaggccaaaacagcagtattcttgttcttgtcatgttttttctgaagaactgatattttccgagttgtgtagccttactgagtgccttcaggatgagcaggttgtagtacccagcaatcaaataaagtgcctgctggtgggcttttcgactctccgtaatatcaaaatgcatataccgttggaagttcgactcctagaatcagctgaactcaaaacttttagctgttcattgcttcatgatggagatccaacttaccagcgtttatttttggactgccttctacattcattgcgggagcttcatacaggagatgttatgattttgcctgtactttcttgcttcacaagatttatggctggtttgatctttgtactccacagttgttttagattcatcacttttgtttgtcccacatcctctgatcccctgaggacctgcgcagtcctgctatgtgttggttatcaggaccttccaaatccagttttccgatatttgcagagtgtgaatgaattgttgagcactttgctcaactctgactcaccccagcaggttttacagtttgtgccaatggaggtactccttaagggggccctgcttgattttttgtgggatttgaatgctgccattgctaaaaggcatttgcatttcattattcaaagagagagagaagaaattatcaacagccttcagttacaaaactgaacatatgctttctgagattcaactttatgatttcttataatttgcccagtatttgcatcctgttgctctattaatttaaaaaccttttattttggggaaaggccaacatttgcatcattcaaagtctcattaattctggaaaaccatccattctgatctctagggtatatacacccacaggcatagagctcttccacgtggtggaatctatgcaatgatagatattcacactctaaatatgaggtgtgtgtatgtgtatgggtggccacagccatgcttacctatgccatttagttggtcttacttaatctgcttaagatttgcatctgtgtacctttgttcagattagttttttttttccagccgatttcctcttagtggctaatgctgttagtgaattttccaactaatttcctctcattggttaatgttgttaatgaattgagagaggtaattgaggaaaggaaatgagtaaatcactgttcagcaacactgatttccgttaacacatcagttatgaatttcagggaattcatctcgccagattcttgataacatgccattcattgcccttaggtgattgaccctattttcttacatggctcaaataaaactagtatgctgttgtatgaatcttttactgaccacaccatccaactataaaaatataacgggacagctttaaaccaaagatcatgtttagaacaatgaaaaattatttgttgtatctaatacacgcctgtattgtgaaaagcttcatttagcaatgatgtaataatttttaacttccaggaaataatctgtgaatggaaagattttttaagattttgagatagtgtttagtctcatgttgggaacacatgaatgtgatgaacatagtgaatactaaagaaaacgcttcagactttcagaatgatggttcagaatttaaaatttttaatcttttctaatttctttttttcagtgtgaaaatagcactttaccaaaagattagccatgaaatggttattttgccagttacatttgatttcttttgtatctgcaatgtaatgagttattttatttcttctgtatttgcagtgtaatgagtttttgtggcaaagtgtattaagcaatttttcattatcttgaagttccacaaagtggagaatatttatattctcacatgcattttaggcacttttgatatgtgaaaatagatgtattttctgatgcatttggttaataaatattaatctgaacattttcatgttctttgctattttgaattccattatagattcatgaataaagtcattactagag

SEQ ID NO: 113994 - DNA, 2592 bp, Homo sapiens
  Payload ID: 2279
  Gene Symbol: CAP1
  Gene Name: CAP, adenylate cyclase-associated protein 1 (yeast)
  Uniprot ID: Q01518
  ENST ID: ENST00000340450
  CDS Start-End: 60-1484
gaagcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaatacc

SEQ ID NO: 113995 - DNA, 1496 bp, Homo sapiens
  Payload ID: 2279
  Gene Symbol: CAP1
  Gene Name: CAP, adenylate cyclase-associated protein 1 (yeast)
  Uniprot ID: Q01518
  ENST ID: ENST00000372792
  CDS Start-End: 67-1494
gccggaagcggagagcggctgatcgcagtccggaggtgaggcggaactctgagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagc

SEQ ID NO: 113996 - DNA, 3105 bp, Homo sapiens
  Payload ID: 2279
  Gene Symbol: CAP1
  Gene Name: CAP, adenylate cyclase-associated protein 1 (yeast)
  Uniprot ID: Q01518
  ENST ID: ENST00000372797
  CDS Start-End: 562-1989
gcggagcgtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttaccaaaatatgcaacttttttttggtgggaagagagattgtcctgtgatttctacccatttcctgaggcctgtggaaataaacctttatgtacttaaagttatacagaaaatagaataaagttaataccaaacttgc

SEQ ID NO: 113997 - DNA, 1563 bp, Homo sapiens
  Payload ID: 2279
  Gene Symbol: CAP1
  Gene Name: CAP, adenylate cyclase-associated protein 1 (yeast)
  Uniprot ID: Q01518
  ENST ID: ENST00000372798
  CDS Start-End: 64-1488
ggaagcggagagcggctgatcgcagtccggaggtgaggcggaactctgagcaggtggtccattatggctgacatgcaaaatctggtagaaagattggagagggcagtgggccgcctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctaga

SEQ ID NO: 113998 - DNA, 2964 bp, Homo sapiens
  Payload ID: 2279
  Gene Symbol: CAP1
  Gene Name: CAP, adenylate cyclase-associated protein 1 (yeast)
  Uniprot ID: Q01518
  ENST ID: ENST00000372802
  CDS Start-End: 558-1982
gtggcctcgatcaccaccgagagctgacggccgcccggattcccgccctcagagaatcctggcccccagtcgttccaagaccctttacggactgcagcttaaaggaaccggcctctgccattgagaccaaactgacagaggaactggtcactcttctgttctttccagagaggagcttagccagggacttctgcccttcctgggcccgggcctcgggggcgattccgggtaggtaaagcggaacgagggcgtggcctctcttgtgagcccgccctccccgtgtcgctcccgccttgagggcggggctctttcccaagtgccctctgtgagagccgggccgctctctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggagcaggtggtccattatggctgacatgcaaaatctggtagaaagattggagagggcagtgggccgcctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaacccacatgatttcaaggagtctggcattcctgaatccttcttccctgccaggtgcctgtcacctgtcttcactgcctccttttccctgtcatgctcatcagcttatggcttctgtctaagcacctgaacagaggactgaaacctccactgcaggctggttttaggtcttgaattatgtaagaatcttgcacagcactgctaatgtaaatttcagttgtttttccctctaggacaaacacttacc

SEQ ID NO: 113999 - DNA, 2217 bp, Homo sapiens
  Payload ID: 2279
  Gene Symbol: CAP1
  Gene Name: CAP, adenylate cyclase-associated protein 1 (yeast)
  Uniprot ID: Q01518
  ENST ID: ENST00000372805
  CDS Start-End: 52-1479
gagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgcagtggccccaaaccattctctgcacctaaaccccaaaccagcccatcccccaaacgagccacaaagaaggagccagctgtacttgaactggagggcaagaagtggagagtggaaaatcaggaaaatgtttccaacctggtgattgaggacacagagctgaaacaggtggcttacatatacaagtgtgtcaacacgacattgcaaatcaagggcaaaattaactccattacagtagataactgtaagaaacttggcctggtattcgatgacgtggtgggcattgtggagataatcaacagtaaggatgtcaaagttcaggtaatgggtaaagtgccaaccatatccatcaacaaaacagatggctgccatgcttacctgagcaagaattccctggattgtgaaatagtcagtgccaaatcttccgagatgaatgtcctcattcctacagaaggcggtgactttaatgaattcccagttcctgagcagttcaagaccctatggaacgggcagaagttggtcaccacagtgacagaaattgctggataagcgaagtgccactgggttctttgccctcccttcacaccatgggataaatctgtatcaagacggttcttttctagatttcctctacctttttgctcttaaaactgcttctctgctctgagaagcacagctacctgccttcactgaaatatacctcaggctgaaatttggggtgggatagcaggtcagttgatcttctgcaggaaggtgcagcttttccatatcagctcaaccacgccgccagtccattcttaaggaactgccgactaggactgatgatgcattttagctttgagcttttgggggttattctaccaacaaacagtccattggaaagaaaacagtccctggaattaacagatcagaatgttcacactggttaatctttttttaacaatgagcatgaaggtagcagaagctggtgtgtttccagatggttcttctaaccaaactaatttttcactgttgacaagcgaggcaagggttgcactggaccaaaggctgaggcttggccatctagcattccatacaaaattgtttcctataagcattccttttattctctattctatcctgggtctgcctcaaccgtgagataggagagtctctggtactagctgctgtagcagtgcccttcatccagggcagttaatggagtcttggaccctttctttctctgggatccctgcccagcaccttcctatagagatgactttaaaaggaaaaaaaaaaaaaaaaaaa

SEQ ID NO: 114000 - DNA, 273 bp, Homo sapiens
  Payload ID: 2279
  Gene Symbol: CAP1
  Gene Name: CAP, adenylate cyclase-associated protein 1 (yeast)
  ENST ID: ENST00000446031
  CDS Start-End: 98-273
ctacgcgcgtgtcatgaaccctgccgagagggccggggctgaggccctcaggccgacccggactcttgggcgcggtctcttgagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtactt

SEQ ID NO: 114001 - DNA, 681 bp, Homo sapiens
  Payload ID: 2279
  Gene Symbol: CAP1
  Gene Name: CAP, adenylate cyclase-associated protein 1 (yeast)
  ENST ID: ENST00000449311
  CDS Start-End: 159-681
tttacggactgcagcttaaaggaaccggcctctgccattgagaccaaactgacagaggaactggtcactcttctgttctttccagagaggagcttagccagggacttctgcccttcctgggcccgggcctcgggggcgattccggcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatg

SEQ ID NO: 114002 - DNA, 528 bp, Homo sapiens
  Payload ID: 2279
  Gene Symbol: CAP1
  Gene Name: CAP, adenylate cyclase-associated protein 1 (yeast)
  ENST ID: ENST00000414893
  CDS Start-End: 93-528
ggtcgcgcggagattgctgggcggttcttgccggaagcggagagcggctgatcgcagtccggaggtgaggcggaactctgaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcagggggagagcattacacatgccctgaaacatgtatctgatgacatgaagactcacaagaaccctgccctgaaggctcagagtggtccagtacgca

SEQ ID NO: 114003 - DNA, 610 bp, Homo sapiens
  Payload ID: 2279
  Gene Symbol: CAP1
  Gene Name: CAP, adenylate cyclase-associated protein 1 (yeast)
  ENST ID: ENST00000417287
  CDS Start-End: 83-610
ggaggtgaggcggaactctgaggacatagacctggaggcttctgctgctgctgcaggccaaggaatggaaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggat

SEQ ID NO: 114004 - DNA, 824 bp, Homo sapiens
  Payload ID: 2279
  Gene Symbol: CAP1
  Gene Name: CAP, adenylate cyclase-associated protein 1 (yeast)
  ENST ID: ENST00000421589
  CDS Start-End: 215-824
tctccggggcgtggcgaagaggggcggagtcacgagcggggcggtgagacttcctgcccagtcgcgggccagcctagcgcttcagccggcggctcatttccggtgggggcgccgcgcccagtgagggcccggaagtgggtcgcgcggagattgctgggcggttcttgccggaagcggagagcggctgatcgcagtccggagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccg

SEQ ID NO: 114005 - DNA, 772 bp, Homo sapiens
  Payload ID: 2279
  Gene Symbol: CAP1
  Gene Name: CAP, adenylate cyclase-associated protein 1 (yeast)
  ENST ID: ENST00000414281
  CDS Start-End: 149-772
attgctgggcggttcttgccggaagcggagagcggctgatcgcagtccggaggtgaggcggaactctgaggcagatatcctccctttcctcctcggctgctgctcttactttgacaagccaggctaacattgaagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagc

SEQ ID NO: 114006 - DNA, 668 bp, Homo sapiens
  Payload ID: 2279
  Gene Symbol: CAP1
  Gene Name: CAP, adenylate cyclase-associated protein 1 (yeast)
  ENST ID: ENST00000420216
  CDS Start-End: 130-668
ttgctgggcggttcttgccggaagcggagagcggctgatcgcagtccggaggcagatatcctccctttcctcctcggctgctgctcttactttgacaagccaggctaacattgaagcaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgt

SEQ ID NO: 114007 - DNA, 817 bp, Homo sapiens
  Payload ID: 2279
  Gene Symbol: CAP1
  Gene Name: CAP, adenylate cyclase-associated protein 1 (yeast)
  ENST ID: ENST00000435719
  CDS Start-End: 30-817
ggctgatcgcagtccggaggtggtccattatggctgacatgcaaaatctggtagaaagattggagagggcagtgggccgcctggaggcagtatctcatacctctgacatgcaccgtgggtatgcagacagtccttcaaaaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaagaactgagcggactgccatctggaccctctgccggatcatgtcctcctccccctccaccatgcccccctcctcccccagtctctaccatttcatgctcatatgagtctgcttcccgctcatcactgttcgcgcagattaatcaggg

SEQ ID NO: 114008 - DNA, 702 bp, Homo sapiens
  Payload ID: 2279
  Gene Symbol: CAP1
  Gene Name: CAP, adenylate cyclase-associated protein 1 (yeast)
  ENST ID: ENST00000424977
  CDS Start-End: 98-702
ggaggtgaggcggaactctgaggcagatatcctccctttcctcctcggctgctgctcttactttgacaagccaggctaacattgaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccatac

SEQ ID NO: 114009 - DNA, 739 bp, Homo sapiens
  Payload ID: 2279
  Gene Symbol: CAP1
  Gene Name: CAP, adenylate cyclase-associated protein 1 (yeast)
  ENST ID: ENST00000427843
  CDS Start-End: 93-739
ctgatcgcagtccggaggcagatatcctccctttcctcctcggctgctgctcttactttgacaagccaggctaacattgaaggtggtccattatggctgacatgcaaaatctggtagaaagattggagagggcagtgggccgcctggaggcagtatctcatacctctgacatgcaccgtgggtatgcagacagtccttcaaaagcaggagcagctccatatgtgcaggcatttgactcgctgcttgctggtcctgtggcagagtacttgaagatcagtaaagagattgggggagacgtgcagaaacatgcggagatggtccacacaggtttgaagttggagcgagctctgttggttacagcttctcagtgtcaacagccagcagaaaataagctttccgatttgttggcacccatctcagagcagatcaaagaagtgataacctttcgggagaagaaccgaggcagcaagttgtttaatcacctgtcagctgtcagcgaaagtatccaggccctgggctgggtggctatggctcccaagcctggcccttatgtgaaagaaatgaatgatgccgccatgttttatacaaaccgagtcctcaaagagtacaaagatgtggataagaagcatgtagactgggtcaaagcttatttaagtatatggacagagctgcaggcttacattaaggagttccataccaccggactggcctggagcaaaacggggcctgtggcaaaaga

SEQ ID NO: 114010 - DNA, 3316 bp, Homo sapiens
  Payload ID: 2280
  Gene Symbol: CAP2
  Gene Name: CAP, adenylate cyclase-associated protein, 2 (yeast)
  Uniprot ID: P40123
  ENST ID: ENST00000229922
  CDS Start-End: 533-1966
atattgggtctggggacacacatgccgtctcttgattcctaaggatccattacccatttctctgcacagatcttcgggtatccaacctatctgtgcctccttcagccaggagcctccggatctttccagacttctttgcaatactgcctcatgcactgaatccatttctcgcatagcctggcgcttggcaggcaggctggcgttccctggctctgccttccccatctccctgtcttttctcccacggcccatctgcccctcctttcctccacccccttctcctctctgctcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatgaa

SEQ ID NO: 114011 - DNA, 1812 bp, Homo sapiens
  Payload ID: 2280
  Gene Symbol: CAP2
  Gene Name: CAP, adenylate cyclase-associated protein, 2 (yeast)
  ENST ID: ENST00000378990
  CDS Start-End: 104-1459
ggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccataatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagt

SEQ ID NO: 114012 - DNA, 861 bp, Homo sapiens
  Payload ID: 2280
  Gene Symbol: CAP2
  Gene Name: CAP, adenylate cyclase-associated protein, 2 (yeast)
  Uniprot ID: P40123
  ENST ID: ENST00000493172
  CDS Start-End: 86-739
aaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattct

SEQ ID NO: 114013 - DNA, 1430 bp, Homo sapiens
  Payload ID: 2280
  Gene Symbol: CAP2
  Gene Name: CAP, adenylate cyclase-associated protein, 2 (yeast)
  ENST ID: ENST00000489374
  CDS Start-End: 116-1213
attcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagtt

SEQ ID NO: 114014 - DNA, 1404 bp, Homo sapiens
  Payload ID: 2280
  Gene Symbol: CAP2
  Gene Name: CAP, adenylate cyclase-associated protein, 2 (yeast)
  Uniprot ID: P40123
  ENST ID: ENST00000465994
  CDS Start-End: 37-1278
attgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgc

SEQ ID NO: 114015 - DNA, 891 bp, Homo sapiens
  Payload ID: 2280
  Gene Symbol: CAP2
  Gene Name: CAP, adenylate cyclase-associated protein, 2 (yeast)
  ENST ID: ENST00000476263
  CDS Start-End: 17-331
agggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgaggccaacaagttttaggatataatgagtaattgacctgggaaattaaacaaaaataatttcaccgccaaccacagactgtacccataatggaggctggctgtctcacagacttttgctgctggccagagtgaatgactcagcacaagtcaaccccaggagagaaacaatacagagctcacccctggctgattgagggccagaagcgccattcttgtagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaggtcctgtagcatccacagtat

SEQ ID NO: 114016 - DNA, 1378 bp, Homo sapiens
  Payload ID: 2280
  Gene Symbol: CAP2
  Gene Name: CAP, adenylate cyclase-associated protein, 2 (yeast)
  ENST ID: ENST00000479291
  CDS Start-End: 37-621
attgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccataatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctggtccttatgtcaaggagatgaatgacgctgccaccttttacactaacagggtcttaaaggactacaaacacagtgatttgcgtcatgtggattgggtgaagtcatatttgaacatttggagtgaacttcaagcatacatcaaggaacaccacaccacgggcctcacatggagcaaaacaaatgagaagagacggaggcaaagataagtgactttgcaaggggcagctcacggagatccagtgaagggaacatctaatcagtttgatttcgagtccactgtacgggtcctgtagcatccacagtatcagcgttttctgtcctctcctctgggcctggccttcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctga

SEQ ID NO: 114017 - DNA, 2686 bp, Homo sapiens
  Payload ID: 2280
  Gene Symbol: CAP2
  Gene Name: CAP, adenylate cyclase-associated protein, 2 (yeast)
  ENST ID: ENST00000611958
  CDS Start-End: 154-1338
gactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgtctcccaaacctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatg

SEQ ID NO: 114018 - DNA, 2776 bp, Homo sapiens
  Payload ID: 2280
  Gene Symbol: CAP2
  Gene Name: CAP, adenylate cyclase-associated protein, 2 (yeast)
  ENST ID: ENST00000616440
  CDS Start-End: 244-1428
tcccctttatttccactccccacccgcgtggctttgctctccctctcccccctcagctcgtctgtatttggagctccggaagctgccggcgactctcccctggagcagcgtgactgacaccggctcctattcagctgggaggagggagaggggaggagaaggggagggccgcgggaggagggtacgagtggccgaccacggatttgcattgccgaggacgggaccccagggcagcgaagcagaatggccaacatgcagggactggtggaaagactggaacgagctgtcagccgcctggagtcgctgtctgcagagtcccacaggccccctgggaactgcggggaagtcaatggtgtcattgcaggtgtggcaccctccgtggaagcctttgacaagctgatggacagtatggtggccgagtttttaaagaacagtaggatccttgctggggacgtggagacccatgcagaaatggtgcacagtgctttccaggcccagcgggctttccttctgatggcctctcagtaccaacaaccccacgagaatgacgtggccgcacttctgaaacccatatcggaaaagattcaggaaatccaaactttcagagagagaaaccgggggagtaacatgtttaatcatctttcggccgtcagcgaaagcatccctgcccttggatggatagctgtgcctccaccccctcctcctctgcctcctccagggccacctccacttttcgagaatgaaggcaaaaaagaggaatcttctccttcacgctcagctttatttgcccaacttaaccagggagaagcaattacaaaagggctccgccatgtcacagatgaccagaagacatacaaaaatcccagcctgcgggctcaaggagggcaaactcaatctcccaccaaaagtcacactccaagtcccacatctcctaaatcttatccttctcaaaaacatgccccagtgttggagttggaaggaaagaaatggagagtggagtaccaagaggacaggaatgaccttgtgatttcagagactgagctgaaacaagtggcttacattttcaaatgcgaaaaatcaactattcagataaaagggaaagtaaactccattataattgacaactgtaaaaaactcggcctggtgtttgacaatgtggtgggcattgtggaagtgatcaactcccaggacattcaaatccaggtaatggggagagtgccaacaatttccattaataagacagaaggttgccacatatacctcagtgaagatgcattagactgtgagatcgtgagcgccaagtcatctgaaatgaacatacttatccctcaggatggtgattatagagaatttcccattcctgaacagttcaagacagcatgggatggatccaagttaatcactgaacctgcagaaattatggcctaacttcctgagagaccgaaccccctcacctgaatccccctctatcaaacaaacaaaaaagcagcagtaaagagctagaagttgcagtagcccctactgctttagctttggcctccaacgattctgtgctatagatacagcactgtttctggcacgcctcgtgggcattttgaaatatttaacgtttcctcatgatttgcctttgtgtgtgattttagttccacatgatgacttgtgaacattagggatttaaaggaaaaaaaaaaagaattctgttcccctcatatcatgaacacagtaactgataggtaaaaagactgcatgattcacttttacacttatatttcattgctagttaaaaaataaaacctttgagaatctaagatgtacatttttaccttttaggcaatttcaatataatgtagaagtagtagtgtgccctgaaaaatgtacacgttttttcttattgttaccacatgttcacctttatcagcgtggatactgtcagcatgagtacatatttcaacccacgcttgtaaaagacataagagtttataaaggaccaaattcagttccttggtccttggaagacctatattctctgtagttactgaaaaccgaaagtcaattctaattattcatcttacatatttttccaccatgtcatttgaaaacttgcttttcttctgcataagagattcttatgccaaaaacattaaacagaagaaatcattttttttgctatgtaatacctcgcaactttgctctaaaatcaagctcagttattattttccaagtttgaacatgttaaatatcagatgccttgtaaattatgtctttaacgttttcttatagactaatttcctcttttccacctgccagacttgctaaccaagctcgaaaatgaacatgaaaaagccatacatgtattatttctcctaaaacctaaggcattatctgttggtttggcttgctgctcctattttgtagtcttgatagtagatgcttcttcagcgtaagagtagctatgatattcctttttatcttttcagtacatagtgctgaaaaatctgcaacttcttggatcatatttaatgaattatagtataatgcttgcaggcccagtacaagcatatatattgtgcctcttacagcctttggaatacattgtttccattttttaaatatcttctatatccatatagtattcaaattattaatgctcatgtaccaaggttttgctataaaagttttgtctgtatgaataatgtggctttagtaaataatcatttttcaactgtaaacttattctgaaataaagtaaaattctaattgtttaaatactgtgatg

SEQ ID NO: 114019 - DNA, 5833 bp, Homo sapiens
  Payload ID: 2281
  Gene Symbol: CLIP1
  Gene Name: CAP-GLY domain containing linker protein 1
  Uniprot ID: P30622
  ENST ID: ENST00000302528
  CDS Start-End: 109-4392
agatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttt

SEQ ID NO: 114020 - DNA, 5880 bp, Homo sapiens
  Payload ID: 2281
  Gene Symbol: CLIP1
  Gene Name: CAP-GLY domain containing linker protein 1
  Uniprot ID: P30622
  ENST ID: ENST00000358808
  CDS Start-End: 156-4439
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttt

SEQ ID NO: 114021 - DNA, 5568 bp, Homo sapiens
  Payload ID: 2281
  Gene Symbol: CLIP1
  Gene Name: CAP-GLY domain containing linker protein 1
  ENST ID: ENST00000361654
  CDS Start-End: 175-4125
ggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttttt

SEQ ID NO: 114022 - DNA, 2592 bp, Homo sapiens
  Payload ID: 2281
  Gene Symbol: CLIP1
  Gene Name: CAP-GLY domain containing linker protein 1
  ENST ID: ENST00000540539
  CDS Start-End: 2032-2385
cattcagatggacgtgacaggcattctaacccaggagttagcaggcctgagggagagcacgtgaagggcaaggctggtgtctgtgagaccctgtagggtcccgcaaggggacacaaactcatccacatgtgctgaaagtggtgcatctgggaagtccacaggaaaatgagttttgaacacaggccctttcactgcagtttagattgtgattaaaaatatacatatattctccctccacttgtttttttttttttttcctcaaatataaggtaatacagacactcaggcagacgaggatgaaagagcccaggagagtcaggtaatgttcctgccttattgctttactttcttgctgtttttcaaaatcattgaatcttttcgtttattttccttctcatttgatgccttttgtatcatttagtcttttgaattggtaatgcattcctctagtccaaacattaaacagaattaaaaatatatacattaaatgtcttcctccaaaccttctctctcttctgctcagttcccaaccctgcaaacagttaattactgttatttgtgtctttccttttcagagattttttaaagtgtgtatacaagccagcactaatacagtcttccctcccttttttttttttaacataaataatggcatactacataaacggttctgcacttattttttttatagctatgtagtgttccattacgtggatttactataatttagtcagttccctattggttgacaatgacactgggatgtttctgatcctttgggtgtattataaacaatgccgtaaggaattatcttgggcagctatcattttatatattagtatttctgcaggatgaattcctagaagtagaattgctctgtcaaagggtttgttactcatctgaaccttaaaaagactggtttcttgaaaactcagtctcttaaagcgaaaattaacaaaacaactttagttttaaactaaaaatgggattaggccaggaatggtggcttatccctgtaattccagcactttgggaggccaaggtgggatgattgcttgagcccaaaagtttgagaccaacctggacatagcgagacctcatctctacaaaaaaaaaaaaacaaaaaaaacaaaaaacaatcctgcagcctgagtgacagagcaacaccctgtctcaaaacaattacttaattaaaaaaaagtttttaagggcctgggccaggtgcagtggctcacgcctataattccagctttttggaaggctgtggcaagcggactgtttgagatcaggagatcgagaccagcctgagcaacaatggcaagaccccatctctacaaaaaataaaattagttaggcatggcgccatgctcccatagtcccagttaccccagaagctgaggcaggaggatcacttgagtccagaaggttgaggctgcagtgagccatgatcatgccaccgcacttaggcctgactgacaaagcaagaacctgtctcagaaaaaaaaaaggtggggtggggggcccgggcacagcagctcacacctgcaatcccagcactttggtaggccaaggtaggcagatcgctggagcccgagaccagcctgcgcaacatgggcactccaagctgggtgacagagcaaggccctgtctcaaaacaaacaaaaatttgtaaaaagggattatataaaggcaaactattctgtacttggaaatataattgtatatagcaacaaacatctgtcttttaattttaatatactttgtatgtattagtcatgttcaaaattcaaaagtacaaaagccacattttatatttaaataaaagaaaaactcaccttgagatgttagttgccagacacctcctttgaggggcacaaaacgattcaacactgtacaaacttaccatggattagcattgtcctctttgtatgtctactgggcttaataactaacagtgtcttctcttcccccttcctttctgcttcggtttgtttcatctgctgctgacaacacttttcttccaatcagcaaatgattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttc

SEQ ID NO: 114023 - DNA, 2554 bp, Homo sapiens
  Payload ID: 2281
  Gene Symbol: CLIP1
  Gene Name: CAP-GLY domain containing linker protein 1
  ENST ID: ENST00000540304
  CDS Start-End: 145-2554
tgagctgatgcctgccccgattctacagacaccatgagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactacatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaaggt

SEQ ID NO: 114024 - DNA, 4633 bp, Homo sapiens
  Payload ID: 2281
  Gene Symbol: CLIP1
  Gene Name: CAP-GLY domain containing linker protein 1
  ENST ID: ENST00000545889
  CDS Start-End: 151-3192
cttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaagaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttt

SEQ ID NO: 114025 - DNA, 4400 bp, Homo sapiens
  Payload ID: 2281
  Gene Symbol: CLIP1
  Gene Name: CAP-GLY domain containing linker protein 1
  Uniprot ID: P30622
  ENST ID: ENST00000540338
  CDS Start-End: 43-4359
tggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagcaaaagagccagatttctgaagatcctgagaatacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactc

SEQ ID NO: 114026 - DNA, 665 bp, Homo sapiens
  Payload ID: 2281
  Gene Symbol: CLIP1
  Gene Name: CAP-GLY domain containing linker protein 1
  ENST ID: ENST00000535290
  CDS Start-End: 341-665
attaagctgtgaatgaacctcccaaacccaggaatatgatatgagaacatagcctttgaatttctctctcaagtttgacttgaaaaatcagcctcagaaacatctttatcttaagatagatttccgttgctctcagaacgtctctcccctgaccttctgttattaagttcatggacatacagcattttagaattaggtgggggctccgaagtctgcgagtgcagctgtgcacagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatt

SEQ ID NO: 114027 - DNA, 2000 bp, Homo sapiens
  Payload ID: 2281
  Gene Symbol: CLIP1
  Gene Name: CAP-GLY domain containing linker protein 1
  ENST ID: ENST00000537004
  CDS Start-End: 715-2000
gtagctgggactacacgcacgcaccaccatgcccagctaatttttgtattagtagagacggggtttcaccatgttggccagggttgtctctatctcttgacctcatgatcagcctgccttggcctcccaaagtactgcgattacaggcgtgagccaccacgcctggcggggatgcttaaatgtagcccaatcctccagtaaagaatactaagaaaaagtgtttggaaccgaaccaaaataaaaacttgcgtaccagaagtttgcaggtaatacagatatgcgtacatgactggtgttcagctatttaggtggacttgcttgtctctgcttacctgtgttgctgatgctggtcagcagtggagaaaactgagattagatgctgctaatctcagatgggaggataatttcttaggaggaaggacatttcttgagtcatcagctccagattcctttaaagtggtgaggcttcagcccagagggcgactaacatgagaattcctgtttgtgaggtcattgtcatgacctcatagccaggctgttcaaaatgtttgcccagcttctggcaggatatgagctgatgcctgccccgattctacagacaccatgagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactacatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagcaaaagagccagatttctgaagatcctgagaatgtaagagggcacttaactgtgtggatatttcccttgttaacaaagattgatcacagattaaaatgcttattgatatactcaaa

SEQ ID NO: 114028 - DNA, 560 bp, Homo sapiens
  Payload ID: 2281
  Gene Symbol: CLIP1
  Gene Name: CAP-GLY domain containing linker protein 1
  ENST ID: ENST00000539080
  CDS Start-End: 311-560
gagccgacgagccgggaggcgggaggcggcggccgcggcggctgctgctgctgcagtgggacaggtggcggcgaccggcggcgtccgaggagtctcttctgtatatacagaaatatgaatgtgaatgaagtggaaggaagaaaatcaaatagcttgccctttcttaaggggaaacaagtcaatttggaaaggtcccagcgttgtatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcac

SEQ ID NO: 114029 - DNA, 5229 bp, Homo sapiens
  Payload ID: 2281
  Gene Symbol: CLIP1
  Gene Name: CAP-GLY domain containing linker protein 1
  Uniprot ID: P30622
  ENST ID: ENST00000537178
  CDS Start-End: 219-4397
gtcacgctctcccccgccccgagccgacgagccgggaggcgggaggcggcggccgcggcggctgctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgaggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactagg

SEQ ID NO: 114030 - DNA, 1658 bp, Homo sapiens
  Payload ID: 2281
  Gene Symbol: CLIP1
  Gene Name: CAP-GLY domain containing linker protein 1
  ENST ID: ENST00000541108
  CDS Start-End: 108-1160
gatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactagtaaggcccctttctcactacctgcctccacttcccaggcaggattaaggcccgtggtcagtgcccctgctttgctgctttgctgctttgcttgtccttgtgctgaatgttgctcacagcttttgctgtgaaagtctttgcaattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccaggtgaagtctggaccttgttgcggagatggtgatggtttctaaagccactgaggagccgagaagcatgcccggtgcttggcaccgaggagctagacttgagagcacaagaaatgggtgtacatttctttgctgtgcttgtttgaaagctacagtctggggtgccagtttccatgatcacagagatgaagttttgttcttgattcga

SEQ ID NO: 114031 - DNA, 5913 bp, Homo sapiens
  Payload ID: 2281
  Gene Symbol: CLIP1
  Gene Name: CAP-GLY domain containing linker protein 1
  Uniprot ID: P30622
  ENST ID: ENST00000620786
  CDS Start-End: 156-4472
gctgctgctgcagtgggacaggtggcggcgaccggcggcgtccgaggagatttaatccagagactgacttcactatagaacccacagttgtatcaatggttggggaaagatagtggcaacaggcaaaggagaaacagctctgacatacaaagaaaatgagtatgctaaagccaagtgggcttaaggcccccaccaagatcctgaagcctggaagcacagctctgaagacacctacggctgttgtagctccagtagaaaaaaccatatccagtgaaaaagcatcaagcactccatcatctgagactcaggaggaatttgtggatgactttcgagttggggagcgagtttgggtgaatggaaataagcctggatttatccagtttcttggagaaacccagtttgcaccaggccagtgggctggaattgttttagatgaacccataggcaagaacgatggttcggtggcaggagttcggtatttccagtgtgaacctttaaagggcatatttacccgaccttcaaagttaacaaggaaggtgcaagcagaagatgaagctaatggcctgcagacaacgcccgcctcccgagctacttcaccgctgtgcacttctacggccagcatggtgtcttcctccccctccaccccttcaaacatccctcagaaaccatcacagccagcagcaaaggaaccttcagctacgcctccgatcagcaaccttacaaaaactgccagtgaatctatctccaacctttcagaggctggctcaatcaagaaaggagaaagagagctcaaaatcggagacagagtattggttggtggcactaaggctggtgtagtccggtttcttggggagaccgactttgccaagggggagtggtgtggcgtggagttagatgagccacttgggaagaatgatggcgctgttgctggaacaaggtattttcagtgtcaacccaaatatggcttgttcgctcctgtccacaaagttaccaagattggcttcccttccactacaccagccaaagccaaggccaacgcagtgaggcgagtgatggcgaccacgtccgccagcctgaagcgcagcccttctgcctcttccctcagctccatgagctcagtggcctcctctgtgagcagcaggcccagtcggacaggactattgactgaaacctcctcccgttacgccaggaagatctccggtaccactgccctccaggaggccctgaaggagaagcagcagcacattgagcagctgctggcggaacgggatctggagagggcggaggtggccaaggccacgagccacgtgggggagatagagcaggagctagctctggcccgggacggacatgaccagcatgtcctggaattggaagccaaaatggaccagctgcgaacaatggtggaagctgctgacagggagaaggtggagcttctcaaccagcttgaagaggagaaaaggaaggttgaggaccttcagttccgggttgaagaagaatcaattaccaaaggtgatcttgagcaaaagagccagatttctgaagatcctgagaatacgcagaccaaactggagcatgcccgcattaaggagcttgaacagagcctgctctttgaaaagaccaaagctgacaaactccagagggagttagaagacactagggtggctacagtttcagaaaagtcacgtataatggaactggagaaagacctagcattgagagtacaggaagtagctgagctccgaagaaggctagagtccaataagcctgctggggatgtggacatgtcactttcccttttgcaagagataagctctttgcaagaaaagttagaagtcacccgtactgaccaccagagagaaataacttctctgaaggagcattttggagcccgggaagaaactcatcagaaggagataaaggctctgtataccgccacggaaaagctttccaaagagaacgagtcattgaaaagcaagctggagcatgccaacaaagagaactcagatgtgatagctctatggaagtccaaactggagactgccatcgcatcccaccagcaggcgatggaagaactgaaggtatctttcagcaaagggcttggaacagagacggcagaatttgctgaactaaaaacacaaatagagaaaatgagactagattaccaacacgaaatagaaaatttgcagaatcaacaagactctgaacgggctgcccatgctaaagagatggaagccttgagggctaaactgatgaaagttattaaagaaaaggaaaacagtctggaagccatcaggtcgaaactggacaaagcagaagaccagcatctcgtagaaatggaagacacgttaaacaaattacaggaagctgaaataaaggtaaaggagctagaggtactgcaagccaaatgcaatgaacaaaccaaggttattgataattttacatcacagctcaaggctactgaagaaaagctcttggatcttgatgcacttcggaaagccagttccgaaggtaaatcggaaatgaagaaacttagacagcagcttgaggcagctgagaaacagattaaacatttagagattgaaaagaatgctgaaagtagcaaggctagtagcattaccagagagctccaggggagagagctaaagcttactaaccttcaggaaaatttgagtgaagtcagtcaagtgaaagagactttggaaaaagaacttcagattttgaaagaaaagtttgctgaagcttcagaggaggcagtctctgttcagagaagtatgcaagaaactgtaaataagttacaccaaaaggaggaacagtttaacatgctgtcttctgacttggagaagctgagagaaaacttagcagatatggaggcaaaatttagagagaaagatgagagagaagagcagctgataaaggcaaaggaaaaactggaaaatgacattgcagaaataatgaagatgtcaggagataactcttctcagctgacaaaaatgaacgatgaattacgtctgaaagaaagagatgtagaagaattacagctaaaacttacaaaggctaatgaaaatgcaagttttctgcaaaaaagtattgaggacatgactgtcaaagctgaacagagccagcaagaagcagctaaaaagcatgaggaagaaaagaaagaattggagaggaaattgtcggacctggaaaagaaaatggaaacaagccacaaccagtgtcaggagctgaaagccaggtatgagagagccacttctgagacaaaaaccaagcatgaagaaatcctacagaacctccagaagacgctgctggacacagaggacaagctgaagggcgcacgggaggagaacagtggcttgctgcaggagctggaggagctgagaaagcaagccgacaaagccaaagctgctcaaacagcggaagatgccatgcagataatggaacagatgaccaaagagaagactgagactctggcctccttggaggacaccaagcaaacaaatgcaaaactacagaatgaattggacacacttaaagaaaacaacttgaaaaatgtggaagagctgaacaaatcaaaagaactcctgactgtagagaatcaaaaaatggaagaatttaggaaagaaatagaaaccctaaagcaggcagcagctcagaagtcccagcagctttcagcgttgcaagaagagaacgttaaacttgctgaggagctggggagaagcagggacgaagtcacaagtcatcaaaagctggaagaagaaagatctgtgctcaataatcagttgttagaaatgaaaaaaagagaatccaagttcataaaagacgcagatgaagagaaagcttccttgcagaaatccatcagtataactagtgccttactcacagaaaaggatgccgagctggagaaactgagaaatgaggtcacagtgctcaggggagaaaacgcctctgccaagtccttgcattcagttgttcagactctagagtctgataaggtgaagctcgagctcaaggtaaagaacttggagcttcaactcaaagaaaacaagaggcagctcagcagctcctcaggtaatacagacactcaggcagacgaggatgaaagagcccaggagagtcagattgatttcctaaattcagtaatagtggaccttcaaaggaagaatcaagacctcaagatgaaggtggagatgatgtcagaagcagccctgaatgggaacggggatgacctaaacaattatgacagtgatgatcaggagaaacagtccaagaagaaacctcgcctcttctgtgacatttgtgactgctttgatctccacgacacagaggattgtcctacccaggcacagatgtcagaggaccctccccattccacacaccatggcagtcggggtgaggaacgcccatactgtgaaatctgtgagatgtttggacactgggccaccaactgcaatgacgacgaaaccttctgatgaagcctccagtggagaactgggcttgctcagacgcactcgcattgacacaacgtaacaccagcattgtgtgtgcagacttcaggagaactcatgttattttttaaccccgtcaacaaatctaggaaaatattttgatcttcaacaaattgccctttagtctccccgtatgagttagaataataaatatttagtaggtgagttttcacctcgaattttgttttcttgatttttacgtttgaagacattgcaccagatgccattacatttattggccccccgaccttgtagaaaaacccctaccctcacaataccttatttaagtaactttaaattatgccgttacttttcatatttgcactaagatatttccaggctgcatttgtatatttagattttttggttaagctttgacactggaatgagttgaaaaaatgtgccattttgcattttcatctactcatttaaagtattttattcttattcaaagaaatatctgagctctttgcactacctgttatcagtagtgcctttacttcaggcttgataatacttaggtgtgattataaaatcatgaagcaggtaaagggaggggcaagcccccaaactgctgtggggacattttataatctatatgctgcacccacttaatctactgtggtgttttgtttattagttttgcataatttcagcttctatatattgtatgtatatattttttaaaaatctatattttgggaaaaaaacatacacaatgtgtctttctttttggacatttacctttttgaaaaagaaaacacttaaaatgatcattaggacataacagactaggccagacatagcatcttgtggctttgcaaccattttcatttgtttgttttccttttatttcttcaccagatttaaataactggaggaattttctccaatttttttttccttctctggcaggtatccccagcagtcaattaacaataagccagtataaaacacctaaataaccaatctacaatctcccttcacaagtttttttactgtttttagatgaatgtacgatgagaaattcaacgttaataattctggattttcttatcacaaaaaagaaaatgaaggacctcaaagcacctgaacagtttatcgaccagtttgaatctatttatcttcatttgaatgtcttctagaatatgtaaaaagtcataaaatgtatcttccatgctacatgtacaataagaacttctataattgtatatatgcctttgatgtattttcccctcaagattatcaactgtgtgttcgacagtgaatattcaatctggtaccagttgaaatttttggttataaatgtaatacgaattgtttcacaaacagaaaacatgtaaagcagtattaaaatttggccaaacaagtgttctgtatctactttaataaatggttattcttt

SEQ ID NO: 114032 - DNA, 5563 bp, Homo sapiens
  Payload ID: 2282
  Gene Symbol: CLIP2
  Gene Name: CAP-GLY domain containing linker protein 2
  Uniprot ID: Q9UDT6
  ENST ID: ENST00000223398
  CDS Start-End: 328-3468
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccacgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtccaggaccccggca

SEQ ID NO: 114033 - DNA, 5445 bp, Homo sapiens
  Payload ID: 2282
  Gene Symbol: CLIP2
  Gene Name: CAP-GLY domain containing linker protein 2
  Uniprot ID: Q9UDT6
  ENST ID: ENST00000361545
  CDS Start-End: 328-3363
cggctcggccgcggggcgcgcaggcggctgctgggcggcctcggtgcgcgcctcccgccttcccagagacgtggcgcgaggcccgggccctgagcacctatcgcggggatccccggcgccaggagggggtgcagccggtgggcagcgccgcgcagggaggggccgcagcatcctcgccccccagcgcgcccgggcccgagaggaggaggccggggctctccgggcctcccgccgcttagcctgatgctggaaggacgaaggtgagtgaagatggcagagaggacgtgaccagcactcacccttgtccacctgcccagtggcaccgccatgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtgggggccccttttccgaagccacttccaggccaaggcagtcgccagggcttcttgtccccaccttctgaaccttcttcaaacagtagtacaagctcccctcagccagcctgcctgcccagcgaggcccccaggttcaaggtgttggcgggggcggagggcaggggaacgggatccttctcccgctgcccaccaacaccaacacacacacacctctaagctgctggccgaagatgtcaccaaggccaaagacacagtattatgaaggtttggaaacccctctcctcacctcccaccgtgaccttgggcaaaccctggctcggagcccagggcagaggcagctcagagtggaggctctaggcaggtttgacaaaggtcagtaatacggtttcccctggggttgaccagatgttccaaaatatctgcatccacctggagatgcagctaagtgggtccttatgtacacaccacgttcacacacacacagagggaccacgtgtgcacgcatgaccgtgtgggtggcggcgtttgctgtgaaccacgctcaggccacacagagacacatacttggtttctgggactgagacccaggcctggcaggaccgtgcctacagatactgcaaacgttcctacagcctagaggtgcgtatacacacccaagtacacgcagccaggcattcaggggtgtgtttgccacatggagcatcccttcctggtcttgccaggcacctgcacagagcgtctccagccccatctcctaacgggggctgggggtaagagaaatctaactgcgctcccccaacccctcgccctgccatcttcccctcaagcctgctaagttatcccaggcctgtgcgtggtggaaaaagccagccttggccctgcagcctccacctcgccgctgggggaccaacaggttgcttacagctttgcaccccggcatcagcacaggggtccctgccccaccctccggcagctcagggagtgttttcctgtgaggcctcccccatcagtggaccagagggagaagcccgatgccccatcccggctttcccgtaacgcacaggacacgtgtgcaattcataggaacggcccagatcgccctcatgagtgccacctggtacaggtaggtggcgctcacgttcctgcccaaatgcagcccatcggggagtcacagtcagtccccccggcccccctcccagtccctgttggctttcggtagctctcgcatgcagttctattaacagccgtctagaagcgatgctttagtggcctaacccagggtcaaatacagctctttctagcaaaatcaggcagctctgccccatcggtaggggcaccgattagtctactaacagccagaggtccatctagcagggtgccgggaggagctgagcccccggaggtgggctcctggtgacgggtgtccaagaagcggtttccttgggagcttctgcctccgtgggcctctcagcccgccccgtgtggccgcccgggtgtggctcagccatgtcccctccccaggtccttcattcacccctcccctccccacagtggaattgttgaagtgtggcgagtctgtgctcgggacaataaagcttgtgacaggtc

SEQ ID NO: 114034 - DNA, 3141 bp, Homo sapiens
  Payload ID: 2282
  Gene Symbol: CLIP2
  Gene Name: CAP-GLY domain containing linker protein 2
  Uniprot ID: Q9UDT6
  ENST ID: ENST00000395060
  CDS Start-End: 1-3141
atgcagaagcccagcggcctgaagccccccggccgtggggggaagcactccagccccatgggccggacatctactgggtcagcttcatcctcggcggcggtggccgctagctccaaggaaggctccccactgcacaaacagtcatctggaccctcctcctccccggccgcagctgctgcccccgagaagccgggccccaaggcggcggaagtgggggatgacttcctgggggactttgtggtgggcgagcgggtgtgggtgaacggcgtgaagccaggcgtggtgcagtatctgggagagacgcagttcgcaccgggccagtgggctggcgtggtgctggacgacccggtgggcaagaatgatggcgcggtgggcggcgtgcgctacttcgagtgcccggccctccagggtatcttcacgcggccctccaagctgacccggcagcccacggccgagggctcggggagtgatgcccactccgtggagtcgctgactgcccagaacctgtcattgcattcgggcacggccacgcccccgctgaccagccgcgtcatccccctgcgggagagcgtcctcaacagctccgtgaagactggcaacgagtcgggatccaacctctcagacagcggctctgtgaagcggggcgaaaaggacctgcgcctgggggaccgcgtgctggttggcgggacgaagactggcgtggtgcggtacgtgggggagacagactttgccaagggcgagtggtgtggcgtggagctggacgagccccttgggaagaatgatggggcggtggcgggcaccaggtacttccagtgcccacccaagtttggtctcttcgcgcccatccacaaagtgatccgtatcggcttcccatctaccagcccagccaaggccaagaagaccaagcgtatggccatgggtgtgtcagcactgacccacagtcccagcagttcctccatcagctccgtcagctctgtggcctcctccgtggggggtcggcccagccgcagtggcctgctcacggagacctcttcacgctacgcccgcaagatctcgggcaccacggccttgcaggaggcactgaaggagaagcagcagcacattgagcagctgctggctgaacgagacctggaacgggctgaggtggccaaggccacaagccacatctgcgaggtggagaaggagattgccctgctcaaggcacagcatgagcagtatgttgcagaagccgaggagaagctgcagcgagcccggctgctcgtggagagcgtgcggaaagagaaggtggacctgtccaaccagctggaggaggagaggaggaaggtggaggatctgcagttccgcgtggaggaggagtccatcaccaagggagacctggagacccagacgcagctggagcacgcgcgcattggggagctggaacagagcctgctactggagaaggcgcaggccgagcggctgctccgagaattagcggacaacaggctgaccacagtggccgagaagtcgcgcgtgctgcagctggaggaggagctcaccctgcgccgaggtgaaatcgaggagctccagcagtgcctgttgcactcgggtcccccacctccggaccacccagacgccgccgagatcctgcggctacgggagcggctgctctcggccagcaaggaacaccagagggagagtggggtgctgcgggataaatacgagaaggccctgaaggcctaccaggcggaggtggacaagctccgcgcggccaacgagaagtacgcacaggaggtggcgggcctgaaggacaaggttcagcaggccaccagcgagaacatggggctaatggacaactggaaatccaagctggactcgctggcctcggaccaccagaagtccctggaggacctcaaagccaccctgaactcgggcccaggcgcccagcagaaggagatcggcgagctgaaggcagtgatggagggcatcaagatggagcaccagctggagctgggtaacttgcaggccaagcatgacctggagaccgccatgcacgtgaaggagaaggaggccctgcgagagaagctgcaggaggcccaggaggagctggctgggctgcagcggcactggcgggcccagctggaggtgcaagccagccagcaccggctggagctgcaggaggcccaggaccagcgccgggatgccgagctgcgtgtgcacgagctggaaaaactggacgtggagtaccggggccaggcgcaggctatcgagttcctcaaggagcagatctcgctggccgagaagaagatgttggactacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcctgcaggacaagctgaacaagagggacaaagaggtgacagccttgacctcccagaccgagatgctcagggcccaagtaagtgcgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctgagtggcggatcaaggagcagaaactcaaggatgacatccggggcctgcgtgaaaagctgaccgggctggacaaagagaaatccctgtcggatcagaggcgctactccctcatcgaccggtcctcggcgcccgagcttctgcggctgcagcaccagctgatgagcacggaggacgccctgcgggatgcgctggaccaggctcagcaggtggagaagctgatggaggccatgaggagctgccctgacaaggcccagaccatcggcaattccggttctgcaaacggcatccaccagcaggacaaagctcagaaacaagaggacaagcactga

SEQ ID NO: 114035 - DNA, 561 bp, Homo sapiens
  Payload ID: 2282
  Gene Symbol: CLIP2
  Gene Name: CAP-GLY domain containing linker protein 2
  ENST ID: ENST00000493166
  CDS Start-End: 1-561
actacgagcggctgcagcgggcagaagcccagggcaaacaggaggtcgagagtttgcgggagaagctcctggtggctgagaacagactccaggcggtcgaggccctgtgctcctcccagcacacccacatgattgagtcgaatgacatttcagaggagacgatcaggacgaaggaaactgtggagggcgcagtgttagcttctttatatcccctttccagaaatattttgtgcaggcctgcaggacaagctgaacaagagggacaaagaggtgacagccttgacctcccagaccgagatgctcagggcccaacgctggagagcaagtgtaagtcaggcgagaagaaggtggacgccctcctgaaggagaagcggcgcctggaggcagagctggagaccgtgtcccggaagacccatgacgcctcgggccagctagtcctcatcagccaggagctgctgcggaaggagcggagcctgaacgaactgcgggtgttgctgctggaggccaatcgtcactccccagggccggagagggacctgagccgtgaggtacacaaggctg

SEQ ID NO: 114036 - DNA, 564 bp, Homo sapiens
  Payload ID: 2282
  Gene Symbol: CLIP2
  Gene Name: CAP-GLY domain containing linker protein 2
  ENST ID: ENST00000487447
  CDS Start-End: 1-86
gggatgcgctggaccaggctcagcaggtggagaagctgatggaggccatgaggagctgccctgacaaggcccaggacaagcactgatcctgaggggatactgtggagcagcccagtccacaccagagccccacgcggctgcccggcagtacctcctccaggcaggagccgggactgtcactttggagacaaaacagtgtttgtaacaataacgtactcaccgccgcggacaatcccccaccccgatccctcgccagaccaggacgcttcctcaagcccagccttctacagagagtgtgaacggtacagccccggcctgacccggggaccttcagcctggacacccggcagcttctggagtttgtcagtggaggcagaggggatccggccaggcccctctgtccagaaggagctgccctgaggaccatcttagcggccctgtcctctttttccgcccattctccctcgggtctccccagaggggccggcgggggctggggagggggtaagtttatccatgcagacaccaagggggagcatccagtctttaagagccaagtggggg

SEQ ID NO: 114037 - DNA, 3370 bp, Homo sapiens
  Payload ID: 2283
  Gene Symbol: CLIP3
  Gene Name: CAP-GLY domain containing linker protein 3
  Uniprot ID: Q96DZ5
  ENST ID: ENST00000360535
  CDS Start-End: 229-1872
atgcgcagtcgcgcccctccctctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttagccagccctcgatcattgaggccccattattaacagatactcccataataacccccaaatacagaccccatgtcacccagaaagagattccctgagtagcaccttcaggctagtccctatccccaacccctcagagcagattcccagattaacagatttccatatcaccccaaatgatggtgaccctctccacataatgcattacaacagaacattcttgaatcacccaaccctggatcagaaacctccccattaacaaacactgccccttaagtcctcttgaaataaacataggtcacacccccaaagcaaaagagtaacagacattcatgtcattgttccccatttaacatcagtcctctcaagatgtcgtgaccccatggtcaccctgaagcccttagattccaacccctcaatcagagacttccttcattaacaaagacccttgttcttatccctcaagaagaaacccaccataaccagcccactgtcacccctaatttacagacaccaaaacagtcctggaagtgctaattacaggaccccccaagtcttcctaccctctgcaccctcaagaaacccccagtgccttgtatgaagcccaccccacatggcccacagctcctgtgctggccagactcccagaaaattctctattttttaagtaacgacttccccctttgggggaccccaaaatttggaggccccattctaggactctggggatcccaaaccctagagtacacacgtcccaaactcccctgtgccctcaagtcctacagcccctagaagaccccaatgccgtaactcctaggacccccaaatcatggaatcccaaatccccagggaatcccaaatttgaaaatccaatcccaagtccccaggaaacccaatcatgaggtccttgtgcctggtatggaggagactgcagtcaggatatgcattccaggctcccagacacctcaagccctattcacaggcaccaggaaaccccacacaggaattcccatccctggaaactggagaatttcaatgccccgagtccatgggtttcaagacaccaaattccaagagccccagccctaagggaaccccaaatcctaaagcctccatctctaataaatggaaggccccaaggccctgaggggatctcaaatcctggaaccccgatttcaatctacgttctagtcactggcctcaaaggaccccacagcacctgggccagaccaacagctcgagggagaacctgaaggcccagggggtccagggcggacctggggccccgaccaccaaggacagctcacgactgccccttcactgcatgtccccaaactcagcatgactcctgtcctcttcaataaagacgtttctatggcc

SEQ ID NO: 114038 - DNA, 549 bp, Homo sapiens
  Payload ID: 2283
  Gene Symbol: CLIP3
  Gene Name: CAP-GLY domain containing linker protein 3
  ENST ID: ENST00000590559
  CDS Start-End: 150-549
aagctgcttaacctctgggccccagtgtgtgagcctcgcattatgatgtctccccagtctccactttggtccccagcgctgtctgcccgaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcg

SEQ ID NO: 114039 - DNA, 2080 bp, Homo sapiens
  Payload ID: 2283
  Gene Symbol: CLIP3
  Gene Name: CAP-GLY domain containing linker protein 3
  Uniprot ID: Q96DZ5
  ENST ID: ENST00000593074
  CDS Start-End: 315-1958
aatcccgagataaacaaacccggggagggggcagccgcgactgaggggcctgacgcgggaggagaagaatggggggctgggcctgggggaggtggcaggcgctgggcgcacacaccggggccctctatgggtaacgggggtccctatggttgcccaagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcggggaccccgcggcagccgtgcgcctctcgcagcagctgctggcgctgggcgcagatgtgacgctgcgcagccgctggaccaacatgaacgcgcttcactacgcggcctattttgatgtgcccgacctcgtgcgtgtgctgctgaagggtgcgaggccgcgagtggtgaactccacgtgcagtgacttcaaccacggctcagccctgcacatcgctgcttccagcctgtgcctgggcgccgccaaatgtttgctggagcacggcgccaaccctgcgctgaggaatcgaaaaggacaggtgccggcggaggtggtcccagatcctatggacatgtccctggacaaggcagaggcggcactggtggccaaggagctgcggacgcttctggaagaggcagtgccactatcttgcgccctccccaaggtcacgctacccaactatgacaacgtcccaggcaatctcatgcttagcgcactgggcttgcgcctgggagaccgcgtgctgctggatggccagaagacgggcacactgcggttctgtgggaccacggagtttgccagcggccagtgggtgggcgtggagctggacgaacctgagggcaagaacgatggcagcgttgggggcgttcggtacttcatctgccctcccaagcagggtctctttgcctccgtgtccaagatctccaaggcagtggacgcacccccctcctctgtcacctccacaccccggaccccccggatggacttctcccgtgtcaccggcaaaggccgcagggaacacaaaggcaagaagaagaccccatcatccccatctctgggcagcttgcagcagcgtgacggggccaaggctgaggttggagaccaggtccttgtcgcgggccagaagcaggggatcgtgcgcttctacgggaagacagactttgccccaggttactggtatggcattgagctggaccagcccacaggcaagcatgatggctctgtcttcggtgtccggtacttcacttgccccccgaggcatggggtcttcgcaccagcatcccgtattcagaggattggcggatccactgattcccccggggacagcgttggagccaaaaaagtgcatcaagtgacaatgacgcagcccaaacgcaccttcaccacagtccggaccccaaaggacattgcatcagagaactccatttccaggttgctgttctgctgctggttcccctggatgctgagggcggagatgcagtcttagaggccctggacacctgacaaagagacagagtccccactagcatctcctgacacccgaggagccctgagtcaccctgagatagagattcccagtaacacatccagagtagagacccctgttag

SEQ ID NO: 114040 - DNA, 704 bp, Homo sapiens
  Payload ID: 2283
  Gene Symbol: CLIP3
  Gene Name: CAP-GLY domain containing linker protein 3
  ENST ID: ENST00000592017
  CDS Start-End: 305-704
ctccgcccccaccccctgtcggcgtctgggcctcgtccccttctctctgtctcccttgcctcccccatcacgtcccctgacaccgacaccccattgctcccacagtctccccagtctccactttggtccccagcgctgtctgcccgagatccagttgcgcggaggccacccggggccctggaagctcctaggggcttggaccctggagcctgccgggcaccctctccagctgacctctgcctccaggatttgcctgaaggctgcccccaactctgcacccgccccccgagggccaccgaggaccatgactaagacagatcctgccccgatggccccgccaccccgaggagaggaggaagaagaggaggaggaggatgaacccgtccccgaggcccccagccccacccaggagcgccggcagaagcctgttgtgcacccctcggcacctgcccccctccctaaggactacgctttcaccttcttcgatcccaatgacccggcgtgccaggagatcctgtttgaccctcagaccaccatccccgagctgtttgccattgtgcgccagtgggtgccccaagtccagcacaagatagacgtcatcggcaatgagattctgcgccgaggctgccatgtgaacgatcgtgacgggctgaccgacatgacactgctccactatgcgtgcaaagctggggcccacggagtcg

SEQ ID NO: 114041 - DNA, 4293 bp, Homo sapiens
  Payload ID: 2284
  Gene Symbol: CLIP4
  Gene Name: CAP-GLY domain containing linker protein family, member 4
  Uniprot ID: Q8N3C7
  ENST ID: ENST00000320081
  CDS Start-End: 256-2373
gtccccagcgcgtgcgcggggccgtggccgaggcctgcgcgccgcccggccgcctgcactgcgcgcgcgcccaccccgcgtgggaggcagcgggaggggcccggagaggtgtggagcggcgcggcgggaggctccgtgggcggccacgggagacagcgccggcgggagcgcgcctctcggcctttcctccgcgcccccgcgtccccagccggccgctccgagaggacccggaggaggcaggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttaggtatgtgggccccactgactttgcttcaggtatctggcttggacttgagctccgaagcgccaagggaaaaaatgatgggtcagtgggtgacaagcgctatttcacctgtaagccgaaccatggagtcttagttcgaccgagcagagtgacctatcggggaattaatgggtcaaaacttgtggatgagaattgttaagcttctaaaatattaaataagctcaaatatatatatttggtgtaaataaagagtccatggtaaatggtttactttatttagccatattaaaattttgaaaatatagttatcttcttaaaaaccattataacaattcagagagagttctttacaaagccatgaatatgaactatggggaatcatggttcttttaaagcaattttcaaaataagtaccaattaaagctttaggttccaagaagattctgggactcaggaagaaaaagtgccatcaggtgaccagctgttgcatttcttgcttattctgttttgtttttgcacatcataatggatttttcttagtgccctaattgtgaagggtttctctagctttggttatgtgtaatgttcacgtgacctttttttgtcaatcatttttggaatttttctttctttctgtgctttattactaataagtccaatgagtgagtagtagctagatgactagtatgtagttttatattttggtaaaattatttgccctttcagaaatgcctcatctaaagatacatgataattttggagttggaaggggccttagaggctctccagctctgcttcttgcccattgccaaatactgaaatggaagcccgtcttacctggggtcactaactggttggttaactgagctaagaatagactgtgggtctcctcacttgtggcccagtgctctttctgctatacaaaatgtctaatctcagatttttcttctgctgcttgactgcttcatctggatgaactacaaaaaacccatgattaaggtttatgaattcaagtaataattagattttttttgcacagacttacttaacttccttattggatatgtttgtaacacataaacacaaagcacttttcaaacatgatgcacttttatctttgtgaataatttactgtcctttcctcctgggatatgagaaacattttaaaaaacgtatttaacagaagagagcaaataaagatatatcaggaaggatgtattagttatttacttaaatgtttataatatctggattttttttgttttgttactcatagaactggtgttgtttgctgtttttatttctctaattgttgcagagttctgcctgttacaaagctacagaactgtattgtttttattttccttcttgagcacatgttaacaaactaagcttcacattagagtgatgtcataatgtaaaatgtttgcattgtggttaggtattgaagtttatgtcctgtctgtgtaaagattcatcttttattgtaaatatttagactttaccacagaaatattggaacagtttgctttataagattaaaaagcatccttcagaatggagcttgccttgtgcttagaaataatatgttgaactattttgcaatatactattttaaatctaaattctgtcacttcgctgcctttttaaaatagtgtggtatttcaaatattgctagagctattttcctgaaatacatttgcaaaataaggctgctttgtaatcaaggaatatttttattgattgaaggaaatgactgtactgcgattcaaaagtaaacttattttattatacagattatttcttaaaaactctatttataccttaacatgaaatccatgaccacaccaaacttggttattcataatttttcctgttaaatataaaacactgtaagttaaaaacagtaatgccaacattgaatttatttttgaggtcaaagaaccagttgttctctttatatttagatgaggatgattgagtccatatactatgtatgtttacatatactatacatgcacattaggtgttttcatttgtgttttgcttatgaaatgtcatttaaagttcacttcttgagcatcaataaaaagggaagctgtgtggttttggaatggta

SEQ ID NO: 114042 - DNA, 2322 bp, Homo sapiens
  Payload ID: 2284
  Gene Symbol: CLIP4
  Gene Name: CAP-GLY domain containing linker protein family, member 4
  Uniprot ID: Q8N3C7
  ENST ID: ENST00000401605
  CDS Start-End: 259-2058
ggggacgctggctggtgctctcaaaggaggactctaagggaggcctgctgaagcctgccaccaccaccaggttttctgtaattggatctgcacaggggcctcagggagtgcagtatgaaaacacccatttccatgcactcccaaccaacacgctgaacaatctgtactcttggtgagaaagacccatgagggactgaaaattctttttctacgtgacactgagaagacagtcacatggtttgggtggctttctagaagatgaccatagaggaccttccagattttccattagaaggaaatcctttgtttggaagatacccatttatattttctgcttctgataccccagttatcttttccatttctgcagcaccaatgccttcagactgtgaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaagtgagtattaagaagatttagaaaaacacctttcaagatgaacatgatgggattctgtgaagaaagaaaagtggagtgctgtatcttttgcattgcttggtagagttttaacacgtaggagaaaaggtgtgataagtgtattgagaagcgttcttcctccctcctttgcaagcgcaattaaaaatgtcaccagtgactaaaactagtgcactgcatatattttatcttcatagaggtcagaactgttaataaaagttaaaggaattta

SEQ ID NO: 114043 - DNA, 2162 bp, Homo sapiens
  Payload ID: 2284
  Gene Symbol: CLIP4
  Gene Name: CAP-GLY domain containing linker protein family, member 4
  ENST ID: ENST00000401617
  CDS Start-End: 409-2124
aaggaggactctaagggaggcctgctgaagcctgccaccaccaccaggttttctgtaattggatctgcacaggggcctcagggagtgcagtatgaaaacacccatttccatgcactcccaaccaacacgctgaacaatctgtactcttggtgagaaagacccatgagggactgaaaattctttttctacgtgacactgagaagacagtcacatggtttggaattttctttctttgatcctaatgatgcatcatgccaggaaattctttttgatcccaaaacttcagtttcagaattatttgccattttgagacagtgggttcctcaggtccaacaaaacattgacattattggaaatgagattcttaagagaggttgcaatgtgaatgatagagatggattgacagatatgactcttttacattatacctgcaaatctggagctcatggtattggtgatgtggaaacagctgtaaaatttgcaactcagcttattgacctgggagcagacattagtttgcggagtcgctggacaaacatgaatgctttgcattatgctgcttattttgatgtccctgaacttataagagtgattttgaaaacatcgaaaccaaaagatgtggatgccacttgcagtgattttaattttggaacagctttgcatattgcagcatacaacttgtgtgcaggtgctgtgaagtgcctcttggagcagggagcaaatcctgcatttaggaatgacaaaggacagatccctgctgatgttgttccagacccagtagatatgccgttagagatggctgacgccgcagccactgctaaggaaatcaagcagatgcttctagatgcggtgcctctgtcatgtaacatctcaaaggccatgctcccaaattatgatcatgtcactggcaaggcaatgcttacgtcacttggcctgaagttgggggatcgtgttgttattgcaggacagaaggttggtacattaagattttgtggaacaactgaatttgcaagtgggcagtgggctggcattgaactggatgaaccagaaggaaaaaataatggaagtgttggaaaagtccagtactttaaatgtgcccccaagtatggtatttttgcacctctttcaaagataagtaaagcaaaaggtcgaaggaagaatataacacacactccttctacaaaagctgctgtacctctcatcaggtcccagaaaattgacgtagctcatgtgacgtcaaaagtaaatactggattaatgacatcaaaaaaagatagtgcttctgagtcaacactttcattgcctcctggtgaagaacttaaaactgtgacagagaaagatgttgccctgcttggatctgtcagcagctgctcctctacatcttctttggaacacagacagagctaccccaagaaacagaatgcaatcagcagtaacaagaagacaatgagcaaaagcccttccctttcatccagagccagtgctggtttgaattcctcagcaacatctacagcaaataatagccgttgcgagggggaactccgcctcggagagagagtgttagtggtaggacagagactgggcaccattaggttctttgggacaacaaacttcgctccaggatattggtatggtatagagcttgaaaaaccccatggcaagaatgatggttcagttggaggtgtgcagtattttagctgttctccaagatatggaatatttgctcccccatccagggtgcaaagagtaacagattccctggataccctttcagaaatttcttcaaataaacagaaccattcttatcctggttttaggagaagttttagcacaacttctgcttcttcccaaaaggagattaacagaagaaatgctttttccaaatcgaaagctgctttgcgtcgcagttggagcagcacccccaccgcaggtggcattgaagggagcgtgaagctgcacgaggggtctcaggtcctgctcacgagctccaatgagatgggtactgttagcatgtttaggattacgggaatgctggttttgctttttcatgcaacaacacaggagccatctgctgcaatgaaattagcaaagtcaaattgtgtgttctttagggactcattttaaaaaccattaaagacagattgacaacacacttcatacaa
